US009950058B2

(12) United States Patent
Che et al.

(10) Patent No.: US 9,950,058 B2
(45) Date of Patent: Apr. 24, 2018

(54) RSV F PROTEIN MUTANTS

(71) Applicant: Pfizer Inc., New York, NY (US)

(72) Inventors: Ye Che, Groton, CT (US); Philip Ralph Dormitzer, Armonk, NY (US); Alexey Vyacheslavovich Gribenko, New City, NY (US); Luke David Handke, Nyack, NY (US); Avvari Krishna Prasad, Chapel Hill, NC (US); Xiayang Qiu, Mystic, CT (US); Mark Edward Ruppen, Garnerville, NY (US); Xi Song, Waterford, CT (US); Kena Anne Swanson, Pearl River, NY (US); Srinivas Kodali, Hillsborough, NJ (US); Xin Xu, Mahwah, NJ (US); KariAnn Sweeney Efferen, Stamford, CT (US); Ping Cai, New City, NY (US); Kristin Rachael Tompkins, Garrison, NY (US); Lorna del Pilar Nunez, Briarcliff Manor, NY (US)

(73) Assignee: Pfizer Inc., New York, NY (US)

( * ) Notice: Subject to any disclaimer, the term of this patent is extended or adjusted under 35 U.S.C. 154(b) by 0 days.

(21) Appl. No.: 15/385,611

(22) Filed: Dec. 20, 2016

(65) Prior Publication Data

US 2017/0182151 A1 Jun. 29, 2017

Related U.S. Application Data

(60) Provisional application No. 62/421,184, filed on Nov. 11, 2016, provisional application No. 62/387,270, filed on Dec. 23, 2015.

(51) Int. Cl.

| | |
|---|---|
| *A61K 39/155* | (2006.01) |
| *C07K 14/135* | (2006.01) |
| *C12N 15/01* | (2006.01) |
| *C07K 14/005* | (2006.01) |
| *C12N 7/00* | (2006.01) |
| *A61K 39/12* | (2006.01) |
| *A61K 39/00* | (2006.01) |

(52) U.S. Cl.

CPC ............ *A61K 39/155* (2013.01); *A61K 39/12* (2013.01); *C07K 14/005* (2013.01); *C12N 7/00* (2013.01); *A61K 2039/575* (2013.01); *C07K 2319/02* (2013.01); *C07K 2319/21* (2013.01); *C07K 2319/22* (2013.01); *C07K 2319/40* (2013.01); *C07K 2319/70* (2013.01); *C07K 2319/735* (2013.01); *C12N 2760/18522* (2013.01); *C12N 2760/18534* (2013.01); *C12N 2760/18571* (2013.01)

(58) Field of Classification Search

None

See application file for complete search history.

(56) References Cited

U.S. PATENT DOCUMENTS

| | | | | |
|---|---|---|---|---|
| 5,057,540 | A | 10/1991 | Kensil et al. | |
| 5,340,740 | A | 8/1994 | Petitte et al. | |
| 5,656,479 | A | 8/1997 | Petitte et al. | |
| 5,830,510 | A | 11/1998 | Petitte et al. | |
| 6,114,168 | A | 9/2000 | Samarut et al. | |
| 6,500,668 | B2 | 12/2002 | Samarut et al. | |
| 8,563,002 | B2 | 10/2013 | Baudoux et al. | |
| 2014/0248314 | A1 | 9/2014 | Swanson et al. | |
| 2014/0271699 | A1* | 9/2014 | Kwong ................ | C07K 14/005 424/187.1 |
| 2016/0046675 | A1 | 2/2016 | Kwong et al. | |

FOREIGN PATENT DOCUMENTS

| | | |
|---|---|---|
| WO | WO 90/03184 | 4/1990 |
| WO | WO 90/14837 | 12/1990 |
| WO | WO 96/11711 | 4/1996 |
| WO | WO 2004/004762 | 1/2004 |
| WO | WO 2005/002620 | 1/2005 |
| WO | WO 08/114149 | 9/2008 |
| WO | WO 2008/154456 | 12/2008 |
| WO | WO 2009/079796 | 7/2009 |
| WO | WO 2010/006447 | 1/2010 |
| WO | WO 2010/039224 | 4/2010 |
| WO | WO 2010/077717 | 7/2010 |
| WO | WO 2010/149743 | 12/2010 |
| WO | WO 2010/149745 | 12/2010 |
| WO | WO 2011/008974 | 1/2011 |
| WO | WO 2012/103361 | 8/2012 |
| WO | WO 2012/158613 | 11/2012 |
| WO | WO 2013/017713 | 2/2013 |
| WO | WO 2013/049342 | 4/2013 |
| WO | WO 2013/139916 | 9/2013 |
| WO | WO 2014/079842 | 5/2014 |
| WO | WO 2014/160463 | 10/2014 |
| WO | WO 2014/174018 | 10/2014 |
| WO | WO 2017/160463 | 10/2014 |
| WO | WO 2014/202570 | 12/2014 |
| WO | WO 2015/013551 | 1/2015 |
| WO | WO 2017/040387 | 3/2017 |

OTHER PUBLICATIONS

McLellan et al. Structure-Based Design of a Fusion Glycoprotein Vaccine for Respiratory Syncytial Virus. Science, 2013, 342: 592-598.*

McLellan et al. Structure of RSV Fusion Glycoprotein Trimer Bound to a Prefusion-Specific Neutralizing Antibody. Science, 2013, 340:1113-1117.*

Chaiwatpongsakorn, S., et al., “Soluble Respiratory Syncytial Virus Fusion Protein in the Fully Cleaved, Pretriggered State Is Triggered by Exposure to Low-Molarity Buffer,” Journal of Virology, 2011, 3968-7785, vol. 85.

Corti, D., et al., “Cross-neutralization of four paramyxoviruses by a human monoclonal antibody,” Nature, 2013, 439-443, vol. 501.

(Continued)

*Primary Examiner* — Nianxiang Zou

(74) *Attorney, Agent, or Firm* — Austin W. Zhang

(57) ABSTRACT

The present disclosure relates to RSV F protein mutants, nucleic acids or vectors encoding a RSV F protein mutant, compositions comprising a RSV F protein mutant or nucleic acid, and uses of the RSV F protein mutants, nucleic acids or vectors, and compositions.

44 Claims, 14 Drawing Sheets

(56) References Cited

OTHER PUBLICATIONS

Eyles, J., et al., "Nonreplicating vaccines can protect African green monkeys from the Memphis 37 strain of respiratory syncytial virus," Journal of Infectious Diseases, 2013, 319-29, vol. 208.
Harbury, P., et al., "A switch between two-, three-, and four-stranded coiled coils in GCN4 Leucine Zipper Mutants," Science,1993,1401-1407, vol. 262.
Hoppe, H., et al., "A parallel three stranded a-helical bundle at the nucleation site of collagen triple-helix formation", FEBS Letters, 1944,191-195, vol. 344.
Ji, M., et al., "Detection of human brain tumor infiltration with quantitative stimulated Raman scattering microscopy," Science Translat. Med., 2015, 1-13, vol. 7.
McAlinden, A., et al., "a-Helical Coiled-coil Oligomerization Domains Are Almost Ubiquitous in the Collagen Superfamily," Biological Chemistry, 2003, 42200-42207, vol. 278.
McLellan, J., et al., "Structure of RSV Fusion Glycoprotein Trimer Bound to a Prefusion-Specific Neutralizing Antibody", Science, 2013, 1113-1117, vol. 309.
Miroshnikov et al., "Engineering trimeric fibrous proteins based on bacteriophage T4 adhesins", Protein Eng Des Sel, 1998 11:329-414.
Needleman, S., et al., "A general method applicable to the search for similarities in the amino acid sequence of two proteins", Molecular Biology, 1970, 443-453, vol. 48.
Niwa, H., Yamamura, K., & Miyazaki, J., Efficient selection for high-expression transfectants with a novel eukaryotic vector. Gene, 108(2), 193-199, 1991.
Ogun, S., et al., "The Oligomerization Domain of C4-Binding Protein (C4bp) Acts as an Adjuvant, and the Fusion Protein Comprised of the 19-Kilodalton Merozoite Surface Protein 1 Fused with the Murine C4bp Domain Protects Mice against Malaria," Infection and Immunity, 2008, 3817-23, vol. 76.
Pearson, W., et al., "Improved tools for biological sequence comparison", Proc. Nat'l. Acad. Sci., 1988, 2444-2448, vol. 85.
Ruiz-Arguello, M., et al., "Thermostability of the human respiratory syncytial virus fusion protein before and after activation: implications for the membrane-fusion mechanism", J. General Virology, 2004, 3677-3687, vol. 85.
Smith, T., et al., "Comparison of Biosequences," Adv. Appl. Math., 1981, 482-489, vol. 2.
Walsh, E., et al., "Analysis of the Respiratory Syncytial Virus Fusion Protein Using Monoclonal and Polyclonal Antibodies," J. Gen. Virol.,1986, 505-513, vol. 67.
Yunus, A., et al., "Elevated temperature triggers human respiratory syncytial virus F protein six-helix bundle formation", Virology, 2010, 226-37, vol. 396.
Boyington, J., etc., "Structure-Based Design of Head-Only Fusion Glycoprotein Immunogens for Respiratory Syncytial Virus," PLOS One, 2016, pp. 1-21, vol. 11, Issue 7.
Cimica, V., et al., "Novel Respiratory Syncytial Virus-Like Particle (VLP) Vaccine Composed of the Postfusion and Prefusion Conformations of the F Glycoprotein", Clin. Vaccine Immunol, 2016, pp. 1-33.
Cullen, L., et al., "Cotton rat immune responses to virus-like particles containing the pre-fusion form of respiratory syncytial virus fusion protein", J. Transl Med., 2015, vol. 13, Issue 350.
Flynn, J., et al., "Stability characterization of a vaccine antigen based on the respiratory syncytial virus fusion glycoprotein", PLOS One, 2016, pp. 1-18, vol. 11, Issue 10.
Joyce, M. G., et al., "Iterative structure-based improvement of a fusion-glycoprotein vaccine against RSV", Nature Struct & Molecular Bio., 2016, pp. 1-12.
Krarup, A., et al., "A highly stable prefusion RSV F vaccine derived from structural analysis of the fusion mechanism," Nature Comm., 2015, pp. 1-20.
Magro, M., et al., "Neutralizing antibodies against the proactive form of respiratory syncytial virus fusion protein offer unique possibilities for clinical intervention," PNAS, 2011, pp. 1-6.
McLellan, J., et al., "Structure-Based Design Fusion Glycoprotein Vaccine for Respiratory Syncytial Virus," Science, 2013, pp. 592-598, vol. 342.
Melero, J., "Influence of antigen conformation and mode of presentation on the anitbody and protective responses against human respiratory syncytial virus: relevance for vaccine development," Expert Review of Vaccines, 2016, pp. 1-8.
Palomo, M., "Influence of RSV F Glycoprotein Conformation on Induction of Protective Immune Responsess," J. Virol., 2016, pp. 1-40.
Rigter, A., et al., "A Protective and Safe Intranasal RSV Vaccine Based on a Recombinant Prefusion-Like Form of the F Protein Bound to Bacterium-Like Particles," PLOS One, 2013, pp. 1-14, vol. 8, Issue 8.
Stewart-Jones, et al., "A Cysteine Zipper Stabilizes a Pre-Fusion F Glycoprotein Vaccine for Respiratory Syncytial Virus," PLOS One, 2015, pp. 1-16, vol. 10, Issue 6.
Swanson, K., et al., "A Monomeric Uncleaved Respiratory Syncytial Virus F Antigen Retains Prefusion-Specific Neutralizing Epitopes", Journal of Virology, 2014, pp. 11802-11810, vol. 88, Issue 20.
Widjaja, I., et al., "Recombinant Soluble Respiratory Syncytial Virus F Protein That Lacks Heptad Repeat B, Contains a GCN4 Trimerization Motif and Is Not Cleaved Displays Prefusion-Like Characteristics", Plos One, 2015, pp. 1-19.
International Search Report, PCT/IB2016/057502, dated Dec. 9, 2016.
McLellan, J., et al:, "Structure-Based Design of a Fusion Glycoprotein Vaccine for Respiratory Syncytial Virus," Suppl Materials, pp. 1-30.
Cimica, V., et al., "Novel Respiratory Syncytial Virus-Like Particle (VLP) Vaccine Composed of the Postfusion and Prefusion Conformations of the F Glycoprotein", pp. 1-3.

* cited by examiner

FIG. 1

MELLILKANAITTILTAVTFCFASGQNITEEFYQSTCSAVSKGYLSALRTGWYTSVITIE
LSNIKENKCNGTDAKVKLIKQELDKYKNAVTELQLLMQSTPATNNRARRELPRFMN
YTLNNAKKTNVTLSKKRKRRFLGFLLGVGSAIASGVAVSKVLHLEGEVNKIKSALLS
TNKAVVSLSNGVSVLTSKVLDLKNYIDKQLLPIVNKQSCSISNIETVIEFQQKNNRLLE
ITREFSVNAGVTTPVSTYMLTNSELLSLINDMPITNDQKKLMSNNVQIVRQQSYSIMS
IIKEEVLAYVVQLPLYGVIDTPCWKLHTSPLCTTNTKEGSNICLTRTDRGWYCDNAG
SVSFFPQAETCKVQSNRVFCDTMNSLTLPSEVNLCNVDIFNPKYDCKIMTSKTDVS
SSVITSLGAIVSCYGKTKCTASNKNRGIIKTFSNGCDYVSNKGVDTVSVGNTLYYVN
KQEGKSLYVKGEPIINFYDPLVFPSDEFDASISQVNEKINQSLAFIRKSDELLSAIGGY
IPEAPRDGQAYVRKDGEWVLLSTFLGGLVPRGSHHHHHHGSWSHPQFEK

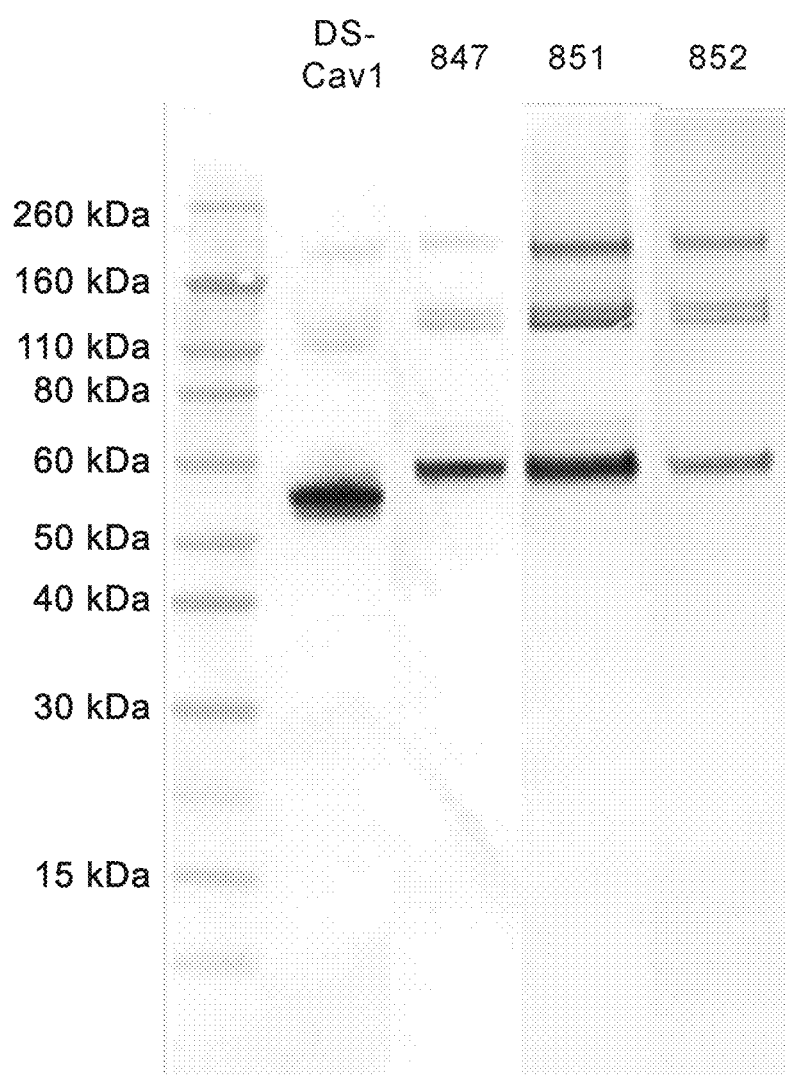

RSV F PROTEIN MUTANTS

REFERENCE TO RELATED APPLICATIONS

This application claims priority to U.S. Provisional Application No. 62/387,270 filed Dec. 23, 2015 and U.S. Provisional Application No. 62/421,184 filed Nov. 11, 2016. The entire content of each of the foregoing applications is incorporated herein by reference.

REFERENCE TO SEQUENCE LISTING

This application is being filed electronically via EFS-Web and includes an electronically submitted sequence listing in .txt format. The .txt file contains a sequence listing entitled "PC72226_02_SeqListing_ST25.txt" created on Nov. 21, 2016 and having a size of 1,286 KB. The sequence listing contained in this .txt file is part of the specification and is herein incorporated by reference in its entirety.

FIELD OF THE INVENTION

The present invention relates to vaccines in general and vaccines against respiratory syncytial viruses specifically.

BACKGROUND OF THE INVENTION

Respiratory syncytial virus, or RSV, is a respiratory virus that infects the lungs and breathing passages. RSV is the leading cause of serious viral lower respiratory tract illness in infants worldwide and an important cause of respiratory illness in the elderly. However, no vaccines have been approved for preventing RSV infection.

RSV is a member of the Paramyxoviridae family. Its genome consists of a single-stranded, negative-sense RNA molecule that encodes 11 proteins, including nine structural proteins (three glycoproteins and six internal proteins) and two non-structural proteins. The structural proteins include three transmembrane surface glycoproteins: the attachment protein G, fusion protein F, and the small hydrophobic SH protein. There are two subtypes of RSV, A and B. They differ primarily in the G glycoprotein, while the sequence of the F glycoprotein is more conserved between the two subtypes.

The mature F glycoprotein has three general domains: ectodomain (ED), transmembrane domain (TM), and a cytoplasmic tail (CT). CT contains a single palmitoylated cysteine residue.

The F glycoprotein of human RSV is initially translated from the mRNA as a single 574-amino acid polypeptide precursor (referred to "F0" or "F0 precursor"), which contains a signal peptide sequence (amino acids 1-25) at the N-terminus. Upon translation the signal peptide is removed by a signal peptidase in the endoplasmic reticulum. The remaining portion of the F0 precursor (i.e., residues 26-574) may be further cleaved at two polybasic sites (a.a. 109/110 and 136/137) by cellular proteases (in particular furin), removing a 27-amino acid intervening sequence designated pep27 (amino acids 110-136) and generating two linked fragments designated F1 (C-terminal portion; amino acids 137-574) and F2 (N-terminal portion; amino acids 26-109). F1 contains a hydrophobic fusion peptide at its N-terminus and two heptad-repeat regions (HRA and HRB). HRA is near the fusion peptide, and HRB is near the TM domain. The F1 and F2 fragments are linked together through two disulfide bonds. Either the uncleaved F0 protein without the signal peptide sequence or a F1-F2 heterodimer can form a RSV F protomer. Three such protomers assemble to form the final RSV F protein complex, which is a homotrimer of the three protomers.

The F proteins of subtypes A and B are about 90 percent identical in amino acid sequence. An example sequence of the F0 precursor polypeptide for the A subtype is provided in SEQ ID NO: 1 (A2 strain; GenBank GI: 138251; Swiss Prot P03420), and for the B subtype is provided in SEQ ID NO: 2 (18537 strain; GenBank GI: 138250; Swiss Prot P13843). SEQ ID NO: 1 and SEQ ID NO:2 are both 574 amino acid sequences. The signal peptide sequence for SEQ ID NO: 1 and SEQ ID NO:2 has also been reported as amino acids 1-25 (GenBank and UniProt). In both sequences the TM domain is from approximately amino acids 530 to 550, but has alternatively been reported as 525-548. The cytoplasmic tail begins at either amino acid 548 or 550 and ends at amino acid 574, with the palmitoylated cysteine residue located at amino acid 550.

One of the primary antigens explored for RSV subunit vaccines is the F protein. The RSV F protein trimer mediates fusion between the virion membrane and the host cellular membrane and also promotes the formation of syncytia. In the virion prior to fusion with the membrane of the host cell, the largest population of F molecules forms a lollipop-shaped structure, with the TM domain anchored in the viral envelope [Dormitzer, P. R., Grandi, G., Rappuoli, R., Nature Reviews Microbiol, 10, 807, 2012.]. This conformation is referred to as the pre-fusion conformation. Pre-fusion RSV F is recognized by monoclonal antibodies (mAbs) D25, AM22, and MPE8, without discrimination between oligomeric states. Pre-fusion F trimers are specifically recognized by mAb AM14 [Gilman M S, Moin S M, Mas V et al. Characterization of a prefusion-specific antibody that recognizes a quaternary, cleavage-dependent epitope on the RSV fusion glycoprotein. PLoS Pathogens,11(7), 2015]. During RSV entry into cells, the F protein rearranges from the pre-fusion state (which may be referred to herein as "pre-F"), through an intermediate extended structure, to a post-fusion state ("post-F"). During this rearrangement, the C-terminal coiled-coil of the pre-fusion molecule dissociates into its three constituent strands, which then wrap around the globular head and join three additional helices to form the post-fusion six helix bundle. If a pre-fusion RSV F trimer is subjected to increasingly harsh chemical or physical conditions, such as elevated temperature, it undergoes structural changes. Initially, there is loss of trimeric structure (at least locally within the molecule), and then rearrangement to the post-fusion form, and then denaturation of the domains.

To prevent viral entry, F-specific neutralizing antibodies presumably must bind the pre-fusion conformation of F on the virion, or potentially the extended intermediate, before the viral envelope fuses with a cellular membrane. Thus, the pre-fusion form of the F protein is considered the preferred conformation as the desired vaccine antigen [Ngwuta, J. O., Chen, M., Modjarrad, K., Joyce, M. G., Kanekiyo, M., Kumar, A., Yassine, H. M., Moin, S. M., Killikelly, A. M., Chuang, G. Y., Druz, A., Georgiev, I. S., Rundlet, E. J., Sastry, M., Stewart-Jones, G. B., Yang. Y., Zhang, B., Nason, M. C., Capella, C., Peeples, M., Ledgerwood, J. E., Mclellan, J. S., Kwong, P. D., Graham, B. S., Science Translat. Med., 14, 7, 309 (2015)]. Upon extraction from a membrane with surfactants such as Triton X-100, Triton X-114, NP-40, Brij-35, Brij-58, Tween 20, Tween 80, Octyl glucoside, Octyl thioglucoside, SDS, CHAPS, CHAPSO, or expression as an ectodomain, physical or chemical stress, or storage, the F glycoprotein readily converts to the post-fusion form [McLellan J S, Chen M, Leung S et al. Structure of RSV fusion glycoprotein trimer bound to a pre-fusion-specific neutralizing antibody. Science 340, 1113-1117 (2013); Chaiwatpongsakorn, S., Epand, R. F., Collins, P. L., Epand R. M., Peeples, M. E., J Virol. 85(8):3968-77 (2011); Yunus, A. S., Jackson T. P., Crisafi, K., Burimski, I., Kilgore, N. R., Zoumplis, D., Allaway, G. P., Wild, C. T., Salzwedel, K. Virology. 2010 Jan. 20; 396(2):226-37]. Therefore, the preparation of pre-fusion F as a vaccine antigen has remained a challenge. Since the neutralizing and protective antibodies function by interfering with virus entry, it is postulated that an F antigen that elicits only post-fusion specific antibodies is not expected to be as effective as an F antigen that elicits pre-fusion specific antibodies. Therefore, it is considered more desirable to utilize an F vaccine that contains a F protein immunogen in the pre-fusion form (or potentially the extended intermediate form). Efforts to date have not yielded an RSV vaccine that has been demonstrated in the clinic to elicit sufficient levels of protection to support licensure of an RSV vaccine. Therefore, there is a need for immunogens derived from a RSV F protein that have improved properties, such as enhanced immunogenicity or improved stability of the pre-fusion form, as compared with the corresponding native RSV F protein, as well as compositions comprising such an immunogen, such as a vaccine.

SUMMARY OF THE INVENTION

In some aspects, the present invention provides mutants of wild-type RSV F proteins, wherein the mutants display introduced mutations in the amino acid sequence relative to the amino acid sequence of the corresponding wild-type RSV F protein and are immunogenic against the wild-type RSV F protein or against a virus comprising the wild-type F protein. The amino acid mutations in the mutants include amino acid substitutions, deletions, or additions relative to a wild-type RSV F protein.

In some embodiments, the present disclosure provides mutants of a wild-type RSV F protein, wherein the introduced amino acid mutations are mutation of a pair of amino acid residues in a wild-type RSV F protein to a pair of cysteines ("engineered disulfide mutation"). The introduced pair of cysteine residues allows for formation of a disulfide bond between the cysteine residues that stabilize the protein's conformation or oligomeric state, such as the pre-fusion conformation. Examples of specific pairs of such mutations include: 55C and 188C; 155C and 290C; 103C and 148C; and 142C and 371C, such as S55C and L188C; S155C and S290C; T103C and I148C; and L142C and N371C.

In still other embodiments, the RSV F protein mutants comprise amino acid mutations that are one or more cavity filling mutations. Examples of amino acids that may be replaced with the goal of cavity filling include small aliphatic (e.g. Gly, Ala, and Val) or small polar amino acids (e.g. Ser and Thr) and amino acids that are buried in the pre-fusion conformation, but exposed to solvent in the post-fusion conformation. Examples of the replacement amino acids include large aliphatic amino acids (Ile, Leu and Met) or large aromatic amino acids (His, Phe, Tyr and Trp). In some specific embodiments, the RSV F protein mutant comprises a cavity filling mutation selected from the group consisting of:

(1) substitution of S at position 55, 62, 155, 190, or 290 with I, Y, L, H, or M;
(2) substitution of T at position 54, 58, 189, 219, or 397 with I, Y, L, H, or M;
(3) substitution of G at position 151 with A or H;
(4) substitution of A at position 147 or 298 with I, L, H, or M;
(5) substitution of V at position 164, 187, 192, 207, 220, 296, 300, or 495 with I, Y, H; and
(6) substitution of R at position 106 with W.

In some particular embodiments, a RSV F protein mutant comprises at least one cavity filling mutation selected from the group consisting of: T54H, S190I, and V296I.

In still other embodiments, the present disclosure provides RSV F protein mutants, wherein the mutants comprise electrostatic mutations, which decrease ionic repulsion or increase ionic attraction between resides in a protein that are proximate to each other in the folded structure. In several embodiments, the RSV F protein mutant includes an electrostatic substitution that reduces repulsive ionic interactions or increases attractive ionic interactions with acidic residues of Glu487 and Asp489 from another protomer of RSV F trimer. In some specific embodiments, the RSV F protein mutant comprises an electrostatic mutation selected from the group consisting of:

(1) substitution of E at position 82, 92, or 487 by D, F, Q, T, S, L, or H;
(2) substitution of K at position 315, 394, or 399 by F, M, R, S, L, I, Q, or T;
(3) substitution of D at position 392, 486, or 489 by H, S, N, T, or P; and
(4) substitution of R at position 106 or 339 by F, Q, N, or W.

In still other embodiments, the present disclosure provides RSV F protein mutants, which comprise a combination of two or more different types of mutations selected from engineered disulfide mutations, cavity filling mutations, and electrostatic mutations. In some particular embodiments, the present invention provides a mutant of a wild-type RSV F protein, which comprises a combination of mutations relative to the corresponding wild-type RSV F protein, wherein the combination of mutations is selected from the group consisting of:

(1) combination of T103C, I148C, S190I, and D486S;
(2) combination of T54H S55C L188C D486S;
(3) combination of T54H, T103C, I148C, S190I, V296I, and D486S;
(4) combination of T54H, S55C, L142C, L188C, V296I, and N371C;
(5) combination of S55C, L188C, and D486S;
(6) combination of T54H, S55C, L188C, and S190I;
(7) combination of S55C, L188C, S190I, and D486S;
(8) combination of T54H, S55C, L188C, S190I, and D486S;
(9) combination of S155C, S190I, S290C, and D486S;
(10) combination of T54H, S55C, L142C, L188C, V296I, N371C, D486S, E487Q, and D489S; and
(11) combination of T54H, S155C, S190I, S290C, and V296I.

In another aspect, the present invention provides nucleic acid molecules that encode a RSV F protein mutant described herein. In some other specific embodiments, the present disclosure provides a nucleic acid molecule encoding a RSV F protein mutant, wherein the nucleic acid molecule comprises a nucleotide sequence selected from the group consisting of:

(1) a nucleotide sequence of SEQ ID NO:8;
(2) a nucleotide sequence of SEQ ID NO:9;
(3) a nucleotide sequence of SEQ ID NO:10;
(4) a nucleotide sequence of SEQ ID NO:11;
(5) a nucleotide sequence of SEQ ID NO:12;
(6) a nucleotide sequence of SEQ ID NO:13;

(7) a nucleotide sequence of SEQ ID NO:14;
(8) a nucleotide sequence of SEQ ID NO:15;
(9) a nucleotide sequence of SEQ ID NO:16;
(10) a nucleotide sequence of SEQ ID NO:17; and
(11) a nucleotide sequence of SEQ ID NO:18.

In another aspect, the invention provides compositions that comprise (1) a RSV F protein mutant described in the disclosure, or (2) a nucleic acid molecule or vector encoding such a RSV F protein mutant. In some particular embodiments, the compositions are pharmaceutical compositions, which comprise a RSV F protein mutant provided by the present disclosure and a pharmaceutically acceptable carrier. In still other particular embodiments, the pharmaceutical composition is a vaccine.

The present disclosure also relates to use of a RSV F protein mutant, nucleic acids encoding such as a RSV F protein mutant, or vectors for expressing such a RSV F protein mutant, or compositions comprising a RSV F protein mutant or nucleic acids. In some particular embodiments, the present disclosure provides a method of preventing RSV infection in a subject, comprising administering to the subject an effective amount of a pharmaceutical composition, such as a vaccine, comprising a RSV F protein mutant, a nucleic acid encoding a RSV F protein mutant, or a vector expressing a RSV F protein mutant.

BRIEF DESCRIPTION OF THE DRAWINGS

FIG. 1 depicts the amino acid sequence of the precursor polypeptide template (SEQ ID NO:3) used for the construction of some of the RSV F protein mutants described in the Examples. The precursor polypeptide includes a signal sequence (residues 1-25), F2 polypeptide (residues 26-109), pep27 sequence (residues 110-136), F1 polypeptide (residues 137-513), a T4 fibritin-derived trimerization domain (foldon; residues 518-544), a thrombin recognition sequence (residues 547-552), a histidine tag (residues 553-558), a Streptag II (561-568), and linker sequences (residues 514-517, 545-546, and 559-560). It also includes three naturally occurring substitutions (P102A, I379V, and M447V) relative to the native RSV F sequence set forth in SEQ ID NO:1. The furin cleavage sites are shown as RARR and KKRKRR.

FIG. 2A depicts sodium dodecyl sulfate polyacrylamide gel electrophoresis (SDS-PAGE) and western blot analysis of selected pre-fusion F mutants (pXCS847, pXCS851 and pXCS852) under non-reducing conditions.

DETAILED DESCRIPTION OF THE INVENTION

Figure 2B:
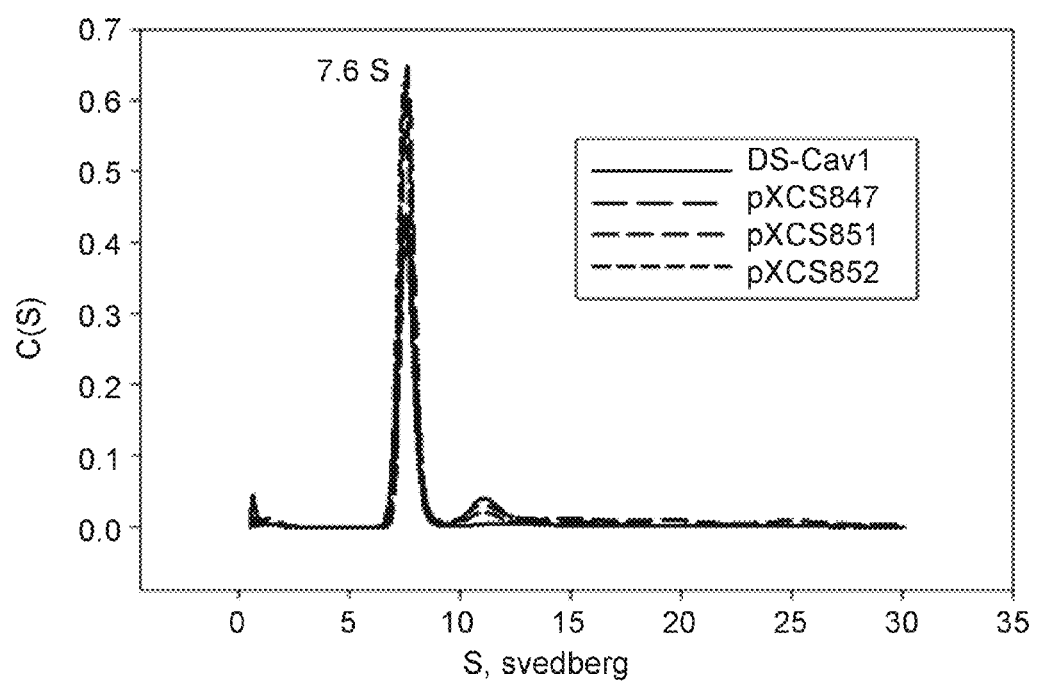
FIG. 2B shows sedimentation coefficient distributions of selected mutants (pXCS847, pXCS851 and pXCS852) calculated from sedimentation velocity experiments using an analytical ultracentrifuge.

The present disclosure relates to RSV F protein mutants, immunogenic compositions comprising the RSV F protein mutants, methods for producing the RSV F protein mutants, compositions comprising the RSV F protein mutants, and nucleic acids that encode the RSV F protein mutants.

A. DEFINITIONS

The term "101F" refers to an antibody described in US 2006/0159695 A1, which has a heavy chain variable domain comprising an amino acid sequence of SEQ ID NO:30 and a light chain variable domain comprising an amino acid sequence of SEQ ID NO:31.

As used herein, the singular forms "a," "an," and "the," refer to both the singular as well as plural, unless the context clearly indicates otherwise. For example, the term "an antigen" includes single or plural antigens and can be considered equivalent to the phrase "at least one antigen."

The term "adjuvant" refers to a substance capable of enhancing, accelerating, or prolonging the body's immune response to an immunogen or immunogenic composition, such as a vaccine (although it is not immunogenic by itself). An adjuvant may be included in the immunogenic composition, such as a vaccine, or may be administered separately from the immunogenic composition.

The term "administration" refers to the introduction of a substance or composition into a subject by a chosen route. Administration can be local or systemic. For example, if the chosen route is intramuscular, the composition (such as a composition including a disclosed immunogen) is administered by introducing the composition into a muscle of the subject.

The term "AM14" refers to an antibody described in WO 2008/147196 A2, which has a heavy chain variable domain comprising an amino acid sequence of SEQ ID NO:24 and a light chain variable domain comprising an amino acid sequence of SEQ ID NO:25.

The term "AM22" refers to an antibody described in WO 2011/043643 A1, which has a heavy chain variable domain comprising an amino acid sequence of SEQ ID NO:26 and a light chain variable domain comprising an amino acid sequence of SEQ ID NO:27.

The term "antigen" refers to a molecule that can be recognized by an antibody. Examples of antigens include polypeptides, peptides, lipids, polysaccharides, and nucleic acids containing antigenic determinants, such as those recognized by an immune cell.

The term "conservative substitution" refers to the substitution of an amino acid with a chemically similar amino acid. Conservative amino acid substitutions providing functionally similar amino acids are well known in the art. The following six groups each contain amino acids that are conservative substitutions for one another:
1) alanine (A), serine (S), threonine (T);
2) aspartic acid (D), glutamic acid (E);
3) asparagine (N), glutamine (Q);
4) arginine (R), lysine (K);
5) isoleucine (I), leucine (L), methionine (M), valine (V); and
6) phenylalanine (F), tyrosine (Y), tryptophan (W).

The term "D25" refers to an antibody described in WO 2008/147196 A2, which has a heavy chain variable domain comprising an amino acid sequence of SEQ ID NO:22 and a light chain variable domain comprising an amino acid sequence of SEQ ID NO:23.

The term "degenerate variant" of a reference polynucleotide refers to a polynucleotide that differs in the nucleotide sequence from the reference polynucleotide but encodes the same polypeptide sequence as encoded by the reference polynucleotide. There are 20 natural amino acids, most of which are specified by more than one codon. For instance, the codons CGU, CGC, CGA, CGG, AGA, and AGG all encode the amino acid arginine. Thus, at every position where an arginine is specified within a protein encoding sequence, the codon can be altered to any of the corresponding codons described without altering the encoded protein. Because of the degeneracy of the genetic code, a large number of functionally identical nucleic acids encode any given polypeptide.

The term "DS-Cav1" refers to the recombinanRSV F protein having the amino acid sequence described in McLellan, et al., Science, 342(6158), 592-598, 2013. DS-Cav1 contains the following introduced amino acid substitutions: S155C, S290C, S190F, and V207L.

The term "effective amount" refers to an amount of agent that is sufficient to generate a desired response. For instance, this can be the amount necessary to inhibit viral replication or to measurably alter outward symptoms of the viral infection.

The term "epitope" (or "antigenic determinant" or "antigenic site") refers to the region of an antigen to which an antibody, B cell receptor, or T cell receptor binds or responds. Epitopes can be formed from contiguous amino acids or noncontiguous amino acids juxtaposed by secondary, tertiary, or quaternary folding of a protein. Epitopes formed from contiguous amino acids are typically retained on exposure to denaturing solvents whereas epitopes formed by higher order folding are typically lost on treatment with denaturing solvents.

The term "F0 polypeptide" (F0) refers to the precursor polypeptide of the RSV F protein, which is composed of a signal polypeptide sequence, a F1 polypeptide sequence, a pep27 polypeptide sequence, and a F2 polypeptide sequence. With rare exceptions the F0 polypeptides of the known RSV strains consist of 574 amino acids.

The term "F1 polypeptide" (F1) refers to a polypeptide chain of a mature RSV F protein. Native F1 includes approximately residues 137-574 of the RSV F0 precursor and is composed of (from N- to C-terminus) an extracellular region (approximately residues 137-524), a transmembrane domain (approximately residues 525-550), and a cytoplasmic domain (approximately residues 551-574). As used herein, the term encompasses both native F1 polypeptides and F1 polypeptides including modifications (e.g., amino acid substitutions, insertions, or deletion) from the native sequence, for example, modifications designed to stabilize a F mutant or to enhance the immunogenicity of a F mutant.

The term "F2 polypeptide" (F2) refers to the polypeptide chain of a mature RSV F protein. Native F2 includes approximately residues 26-109 of the RSV F0 precursor. As used herein, the term encompasses both native F2 polypeptides and F2 polypeptides including modifications (e.g., amino acid substitutions, insertions, or deletion) from the native sequence, for example, modifications designed to stabilize a F mutant or to enhance the immunogenicity of a F mutant. In native RSV F protein, the F2 polypeptide is linked to the F1 polypeptide by two disulfide bonds to form a F2-F1 heterodimer. The term "foldon" or "foldon domain" refers to an amino acid sequence that is capable of forming trimers. One example of such foldon domains is the peptide sequence derived from bacteriophage T4 fibritin, which has the sequence of GYIPEAPRDGQAYVRKDGEWVLLSTFL (SEQ ID NO:40).

The term "subject" refers to either a human or a non-human mammal. The term "mammal" refers to any animal species of the Mammalia class. Examples of mammals include: humans; non-human primates such as monkeys; laboratory animals such as rats, mice, guinea pigs; domestic animals such as cats, dogs, rabbits, cattle, sheep, goats, horses, and pigs; and captive wild animals such as lions, tigers, elephants, and the like.

The term "glycoprotein" refers to a protein that contains oligosaccharide chains (glycans) covalently attached to polypeptide side-chains. The carbohydrate is attached to the protein in a cotranslational or posttranslational modification known as glycosylation. The term "glycosylation site" refers to an amino acid sequence on the surface of a polypeptide, such as a protein, which accommodates the attachment of a glycan. An N-linked glycosylation site is triplet sequence of NX(S/T) in which N is asparagine, X is any residue except proline, and (S/T) is a serine or threonine residue. A glycan is a polysaccharide or oligosaccharide. Glycan may also be used to refer to the carbohydrate portion of a glycoconjugate, such as a glycoprotein, glycolipid, or a proteoglycan.

The term "host cells" refers to cells in which a vector can be propagated and its DNA or RNA expressed. The cell may be prokaryotic or eukaryotic.

The term "identical" or percent "identity," in the context of two or more nucleic acid or polypeptide sequences, refers to two or more sequences or subsequences that are the same or have a specified percentage of amino acid residues or nucleotides that are the same, when compared and aligned for maximum correspondence. Methods of alignment of sequences for comparison are well known in the art. Once aligned, the number of matches is determined by counting the number of positions where an identical nucleotide or amino acid residue is present in both sequences. The percent sequence identity is determined by dividing the number of matches either by the length of the sequence set forth in the identified sequence, or by an articulated length (such as 100 consecutive nucleotides or amino acid residues from a sequence set forth in an identified sequence), followed by multiplying the resulting value by 100. For example, a peptide sequence that has 1166 matches when aligned with a test sequence having 1554 amino acids is 75.0 percent identical to the test sequence (1166÷1554*100=75.0).

Optimal alignment of sequences for comparison can be conducted, e.g., by the local homology algorithm of Smith and Waterman, Adv. Appl. Math. 2:482, 1981, by the homology alignment algorithm of Needleman and Wunsch, Mol. Biol. 48:443, 1970, by the search for similarity method of Pearson and Lipman, Proc. Nat'l. Acad. Sci. USA 85:2444, 1988, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Sambrook et al. (Molecular Cloning: A Laboratory Manual, 4th ed, Cold Spring Harbor, N.Y., 2012) and Ausubel et al. (In Current Protocols in Molecular Biology, John Wiley and Sons, New York, through supplement 104, 2013).

The term "immunogen" refers to a compound, composition, or substance that is immunogenic as defined herein below.

The term "immunogenic" refers to the ability of a substance to cause, elicit, stimulate, or induce an immune response against a particular antigen, in a subject, whether in the presence or absence of an adjuvant.

The term "immune response" refers to any detectable response of a cell or cells of the immune system of a host mammal to a stimulus (such as an immunogen), including, but not limited to, innate immune responses (e.g., activation of Toll receptor signaling cascade), cell-mediated immune responses (e.g., responses mediated by T cells, such as antigen-specific T cells, and non-specific cells of the immune system), and humoral immune responses (e.g., responses mediated by B cells, such as generation and secretion of antibodies into the plasma, lymph, and/or tissue fluids). Examples of immune responses include an alteration (e.g., increase) in Toll-like receptor activation, lymphokine (e.g., cytokine (e.g., Th1, Th2 or Th17 type cytokines) or chemokine) expression or secretion, macrophage activation, dendritic cell activation, T cell (e.g., CD4+ or CD8+ T cell) activation, NK cell activation, B cell activation (e.g., antibody generation and/or secretion), binding of an immunogen (e.g., antigen (e.g., immunogenic polypeptide)) to an MHC molecule, induction of a cytotoxic T lymphocyte ("CTL") response, induction of a B cell response (e.g., antibody production), and, expansion (e.g., growth of a population of cells) of cells of the immune system (e.g., T cells and B cells), and increased processing and presentation of antigen by antigen presenting cells. The term "immune response" also encompasses any detectable response to a particular substance (such as an antigen or immunogen) by one or more components of the immune system of a vertebrate animal in vitro.

The term "immunogenic composition" refers to a composition comprising an immunogen.

The term "MPE8" refers to an antibody described in Corti et al. [Corti, D., Bianchi, S., Vanzetta, F., Minola, A., Perez, L., Agatic, G., Lanzavecchia, A. Cross-neutralization of four paramyxoviruses by a human monoclonal antibody. Nature, 501(7467), 439-443 (2013)], which has a heavy chain variable domain comprising an amino acid sequence of SEQ ID NO:28 and a light chain variable domain comprising an amino acid sequence of SEQ ID NO:29. The term "mutant" of a wild-type RSV F protein, "mutant" of a RSV F protein, "RSV F protein mutant," or "modified RSV F protein" refers to a polypeptide that displays introduced mutations relative to a wild-type F protein and is immunogenic against the wild-type F protein.

The term "mutation" refers to deletion, addition, or substitution of amino acid residues in the amino acid sequence of a protein or polypeptide as compared to the amino acid sequence of a reference protein or polypeptide. Throughout the specification and claims, the substitution of an amino acid at one particular location in the protein sequence is referred to using a notation "(amino acid residue in wild type protein)(amino acid position)(amino acid residue in engineered protein)". For example, a notation Y75A refers to a substitution of a tyrosine (Y) residue at the 75th position of the amino acid sequence of the reference protein by an alanine (A) residue (in a mutant of the reference protein). In cases where there is variation in the amino acid residue at the same position among different wild-type sequences, the amino acid code preceding the position number may be omitted in the notation, such as "75A."

The term "native" or "wild-type" protein, sequence, or polypeptide refers to a naturally existing protein, sequence, or polypeptide that has not been artificially modified by selective mutations.

The term "pep27 polypeptide" or "pep27" refers to a 27-amino acid polypeptide that is excised from the F0 precursor during maturation of the RSV F protein. The sequence of pep27 is flanked by two furin cleavage sites that are cleaved by a cellular protease during F protein maturation to generate the F1 and F2 polypeptides.

The term "pharmaceutically acceptable carriers" refers to a material or composition which, when combined with an active ingredient, is compatible with the active ingredient and does not cause toxic or otherwise unwanted reactions when administered to a subject, particularly a mammal. Examples of pharmaceutically acceptable carriers include solvents, surfactants, suspending agents, buffering agents, lubricating agents, emulsifiers, absorbants, dispersion media, coatings, and stabilizers.

The term "pre-fusion-specific antibody" refers to an antibody that specifically binds to the RSV F glycoprotein in a pre-fusion conformation, but does not bind to the RSV F protein in a post-fusion conformation. Exemplary pre-fusion-specific antibodies include the D25, AM22, 5C4, MPE8, and AM14 antibodies.

The term "pre-fusion trimer-specific antibody" refers to an antibody that specifically binds to the RSV F glycoprotein in a pre-fusion, trimeric conformation, but does not bind to the RSV F protein in a post-fusion conformation or in a pre-fusion conformation that is not also trimeric. An exemplary pre-fusion trimer-specific antibody is the AM14 antibody. "Pre-fusion trimer-specific antibodies" are a subset of "pre-fusion-specific antibodies."

The term "prime-boost vaccination" refers to an immunotherapy regimen that includes administration of a first immunogenic composition (the primer vaccine) followed by administration of a second immunogenic composition (the booster vaccine) to a subject to induce an immune response. The primer vaccine and the booster vaccine typically contain the same immunogen and are presented in the same or similar format. However, they may also be presented in different formats, for example one in the form of a vector and the other in the form of a naked DNA plasmid. The skilled artisan will understand a suitable time interval between administration of the primer vaccine and the booster vaccine. Further, the primer vaccine, the booster vaccine, or both primer vaccine and the booster vaccine additionally include an adjuvant.

The term "pre-fusion conformation" refers to a structural conformation adopted by an RSV F protein or mutant that can be specifically bound by (i) antibody D25 when the RSV F protein or mutant is in the form of a monomer or trimer, or (ii) by antibody AM14 when the RSV F protein mutant is in the form of a trimer. The pre-fusion trimer conformation is a subset of pre-fusion conformations.

The term "post-fusion conformation" refers to a structural conformation adopted by the RSV F protein that is not specifically bound by D25, AM22, or AM14. Native F protein adopts the post-fusion conformation subsequent to the fusion of the virus envelope with the host cellular membrane. RSV F protein may also assume the post-fusion conformation outside the context of a fusion event, for example, under stress conditions such as heat and low osmolality, when extracted from a membrane, when expressed as an ectodomain, or upon storage.

The term "soluble protein" refers to a protein capable of dissolving in aqueous liquid and remaining dissolved. The solubility of a protein may change depending on the concentration of the protein in the water-based liquid, the buffering condition of the liquid, the concentration of other solutes in the liquid, for example salt and protein concentrations, and the temperature of the liquid.

The term "specifically bind," in the context of the binding of an antibody to a given target molecule, refers to the binding of the antibody with the target molecule with higher affinity than its binding with other tested substances. For example, an antibody that specifically binds to the RSV F protein in pre-fusion conformation is an antibody that binds RSV F protein in pre-fusion conformation with higher affinity than it binds to the RSV F protein in the post-fusion conformation.

The term "therapeutically effective amount" refers to the amount of agent that is sufficient to prevent, treat (including prophylaxis), reduce and/or ameliorate the symptoms and/or underlying causes of a disorder.

The term "vaccine" refers to a pharmaceutical composition comprising an immunogen that is capable of eliciting a prophylactic or therapeutic immune response in a subject. Typically, a vaccine elicits an antigen-specific immune response to an antigen of a pathogen, for example a viral pathogen.

The term "vector" refers to a nucleic acid molecule capable of transporting or transferring a foreign nucleic acid molecule. The term encompasses both expression vectors and transcription vectors. The term "expression vector" refers to a vector capable of expressing the insert in the target cell, and generally contains control sequences, such as enhancer, promoter, and terminator sequences, that drive expression of the insert. The term "transcription vector" refers to a vector capable of being transcribed but not translated. Transcription vectors are used to amplify their insert. The foreign nucleic acid molecule is referred to as "insert" or "transgene." A vector generally consists of an insert and a larger sequence that serves as the backbone of the vector. Based on the structure or origin of vectors, major types of vectors include plasmid vectors, cosmid vectors, phage vectors such as lambda phage, viral vectors such as adenovirus (Ad) vectors, and artificial chromosomes.

B. RSV F PROTEIN MUTANTS

In some aspects, the present invention provides mutants of wild-type RSV F proteins, wherein the mutants display introduced mutations in the amino acid sequence relative to the amino acid sequence of the corresponding wild-type RSV F protein and are immunogenic against the wild-type RSV F protein or against a virus comprising the wild-type F protein. In certain embodiments, the RSV F mutants possess certain beneficial characteristics, such as increased immunogenic properties or improved stability in the pre-fusion conformation of the mutants or pre-fusion trimeric conformation of the mutant, as compared to the corresponding wild-type F protein. In still other embodiments, the present disclosure provide RSV F mutants that display one or more introduced mutations as described herein and bind to a pre-fusion specific antibody selected from antibody D25 or antibody AM14.

The introduced amino acid mutations in the RSV F protein mutants include amino acid substitutions, deletions, or additions. In some embodiments, the only mutations in the amino acid sequence of the mutants are amino acid substitutions relative to a wild-type RSV F protein.

The amino acid sequence of a large number of native RSV F proteins from different RSV subtypes, as well as nucleic acid sequences encoding such proteins, is known in the art. For example, the sequence of several subtype A, B and bovine RSV F0 precursor proteins are set forth in SEQ ID NOs:1, 2, 4, 6 and 81-270.

The native RSV F protein exhibits remarkable sequence conservation across RSV subtypes. For example, RSV subtypes A and B share 90% sequence identity, and RSV subtypes A and B each share 81% sequence identify with bovine RSV F protein, across the F0 precursor molecule. Within RSV subtypes the F0 sequence identity is even greater; for example within each of RSV A, B, and bovine subtypes, the RSV F0 precursor protein has about 98% sequence identity. Nearly all identified RSV F0 precursor sequences consist of 574 amino acids in length, with minor differences in length typically due to the length of the C-terminal cytoplasmic tail. Sequence identity across various native RSV F proteins is known in the art (see, for example, WO2014/160463). To further illustrate the level of the sequence conservation of F proteins, non-consensus amino acid residues among F0 precursor polypeptide sequences from representative RSV A strains and RSV B strains are provided in Tables A and B, respectively (where non-consensus amino acids were identified following alignment of selected F protein sequences from RSV A strains with ClustalX (v. 2)).

In view of the substantial conservation of RSV F sequences, a person of ordinary skill in the art can easily compare amino acid positions between different native RSV F sequences to identify corresponding RSV F amino acid positions between different RSV strains and subtypes. For example, across nearly all identified native RSV F0 precursor proteins, the furin cleavage sites fall in the same amino acid positions. Thus, the conservation of native RSV F protein sequences across strains and subtypes allows use of a reference RSV F sequence for comparison of amino acids at particular positions in the RSV F protein. For the purposes of this disclosure (unless context indicates otherwise), the RSV F protein amino acid positions are given with reference to the sequence of the F0 precursor polypeptide set forth in SEQ ID NO: 1 (the amino acid sequence of the full length native F precursor polypeptide of the RSV A2 strain; corresponding to GenInfo Identifier GI 138251 and Swiss Prot identifier P03420). However, it should be noted, and one of skill in the art will understand, that different RSV F0 sequences may have different numbering systems, for example, if there are additional amino acid residues added or removed as compared to SEQ ID NO:1. As such, it is to be understood that when specific amino acid residues are referred to by their number, the description is not limited to only amino acids located at precisely that numbered position when counting from the beginning of a given amino acid sequence, but rather that the equivalent/corresponding amino acid residue in any and all RSV F sequences is intended even if that residue is not at the same precise numbered position, for example if the RSV sequence is shorter or longer than SEQ ID NO:1, or has insertions or deletions as compared to SEQ ID NO: 1.

B-1. Structure of the RSV F Protein Mutants

The RSV F protein mutants provided by the present disclosure comprise a F1 polypeptide and a F2 polypeptide. In several embodiments, the mutants further comprise a trimerization domain. In some embodiments, either the F1 polypeptide or the F2 polypeptide includes at least one introduced modification (e.g., amino acid substitution) as described in detail herein below. In some other embodiments, each of the F1 polypeptide and F2 polypeptide includes at least one introduced modification (e.g., amino acid substitution) as described in detail herein below.

B-1(a). F1 Polypeptide and F2 Polypeptide of the RSV F Mutants

In some embodiments, the mutants are in the mature form of the RSV F protein, which comprises two separate polypeptide chains, namely the F1 polypeptide and F2 polypeptide. In some other embodiments, the F2 polypeptide is linked to the F1 polypeptide by one or two disulfide bonds to form a F2-F1 polypeptide heterodimer. In still other embodiments, the RSV F mutants are in the form a single chain protein, wherein the F2 polypeptide is linked to the F1 polypeptide by a peptide bond or peptide linker. Any suitable peptide linkers for joining two polypeptide chains together may be used. Examples of such linkers include G, GG, GGG, GS, and SAIG linker sequences. The linker may also be the full length pep27 sequence or a fragment thereof.

The F1 polypeptide chain of the mutant may be of the same length as the full length F1 polypeptide of the corresponding wild-type RSV F protein; however, it may also have deletions, such as deletions of 1 up to 60 amino acid residues from the C-terminus of the full-length F1 polypeptide. A full-length F1 polypeptide of the RSV F mutants corresponds to amino acid positions 137-574 of the native RSV F0 precursor, and includes (from N- to C-terminus) an extracellular region (residues 137-524), a transmembrane domain (residues 525-550), and a cytoplasmic domain (residues 551-574). It should be noted that amino acid residues 514 onwards in a native F1 polypeptide sequence are optional sequences in a F1 polypeptide of the RSV F mutants provided herein, and therefore may be absent from the F1 polypeptide of the mutant.

In some embodiments, the F1 polypeptide of the RSV F mutants lacks the entire cytoplasmic domain. In other embodiments, the F1 polypeptide lacks the cytoplasmic domain and a portion of or all entire transmembrane domain. In some specific embodiments, the mutant comprises a F1 polypeptide wherein the amino acid residues from position 510, 511, 512, 513, 514, 515, 520, 525, or 530 through 574 are absent. Typically, for mutants that are linked to trimerization domain, such as a foldon, amino acids 514 through 754 can be absent. Thus, in some specific embodiment, amino acid residues 514 through 574 are absent from the F1 polypeptide of the mutant. In still other specific embodiments, the F1 polypeptide of the RSV F mutants comprises or consists of amino acid residues 137-513 of a native F0 polypeptide sequence, such as any of the F0 precursor sequence set forth in SEQ ID Nos: 1, 2, 4, 6, and 81-270.

On the other hand, the F1 polypeptide of the RSV F mutant may include a C-terminal linkage to a trimerization domain, such as a foldon. Many of the sequences of the RSV F mutants disclosed herein include a sequence of protease cleavage site, such as thrombin cleavage site (LVPRGS), protein tags, such as 6×His-tag (HHHHHH) and Streptag II (WSHPGFEK), or linker sequences (such as GG and GS) (See FIG. 1) that are not essential for the function of the RSV F protein, such as for induction of an immune response. A person skilled in the art will recognize such sequences, and when appropriate, understand that these sequences are not included in a disclosed RSV F mutant.

In the RSV F mutants provided by the present disclosure, the F2 polypeptide chain may be of the same length as the full-length F2 polypeptide of the corresponding wild-type RSV F protein; it may also have deletions, such as deletions of 1, 2, 3, 4, 5, 6, 7, or 8 amino acid residues from the N-terminus or C-terminus of the F2 polypeptide.

The mutant in F0 form (i.e., a single chain polypeptide comprising the F2 polypeptide joined to the F1 polypeptide with or without partial or full length pep 27) or F1-F2 heterodimer form may form a protomer. The mutant may also be in the form of a trimer, which comprises three of the same protomer. Further, the mutants may be glycosylated proteins (i.e., glycoproteins) or non-glycosylated proteins. The mutant in F0 form may include, or may lack, the signal peptide sequence.

The F1 polypeptide and F2 polypeptide of the RSV F protein mutants to which one or more mutations are introduced can be from any wild-type RSV F proteins known in the art or discovered in the future, including, without limitations, the F protein amino acid sequence of RSV subtype A, and subtype B strains, including A2 Ontario and Buenos Aires, or any other subtype. In some embodiments, the RSV F mutant comprises a F1 and/or a F2 polypeptide from a RSV A virus, for example, a F1 and/or F2 polypeptide from a RSV F0 precursor protein set forth in any one of SEQ ID NOs: 1, 2, 4, 6, and 81-270 to which one or more mutations are introduced. In some other embodiments, the RSV F mutant comprises a F1 and/or a F2 polypeptide from a RSV B virus, for example, a F1 and/or F2 polypeptide from a RSV F0 precursor protein set forth in any one of SEQ ID NOs:2, and 211-263 to which one or more mutations are introduced. In still other embodiments, the RSV F mutant comprises a F1 and/or a F2 polypeptide from a RSV bovine virus, for example, a F1 and/or F2 polypeptide from a RSV F0 precursor protein set forth in any one of SEQ ID NOs:264-270 to which one or more mutations are introduced.

In some embodiments, the RSV F protein mutants comprise a F1-polypeptide, a F2 polypeptide, and one or more introduced amino acid mutations as described herein below, wherein the F1 polypeptide comprises 350 consecutive amino acids and is at least 90, 95, 98, or 99 percent identical to amino acids 137-513 of any of the sequences of SEQ ID NO:1, 4, and 81-210, wherein the F2 polypeptide comprises 70 consecutive amino acids and is at least 90, 95, 98, or 99 percent identical to amino acids 26-109 of any of the sequence of SEQ ID NO:1, 4, and 81-210 and wherein RSV F protein mutant is stabilized in pre-fusion conformation, whether as monomer or trimer. In some embodiments, the F1 polypeptide comprises 350 consecutive amino acids and is at least 90, 95, 98, or 99 percent identical to amino acids 137-513 of any of the sequence of SEQ ID NOs:2, 6, and 211-263, and the F2 polypeptide comprises 70 consecutive amino acids and is at least 90, 95, 98, or 99 percent identical to amino acids 26-109 of any of the sequence of SEQ ID NOs:2, 6, and 211-263. In some other embodiments, the RSV F protein mutant is stabilized in pre-fusion trimer conformation.

B-1(b) Trimerization Domains

In several embodiments, the RSV F mutant provided by the present disclosure is linked to a trimerization domain. In some embodiments, the trimerization domain promotes the formation of trimer of three F1/F2 heterodimers.

Several exogenous multimerization domains that promote formation of stable trimers of soluble proteins are known in the art. Examples of such multimerization domains that can be linked to a mutant provided by the present disclosure include: (1) the GCN4 leucine zipper (Harbury et al. 1993 Science 262: 1401-1407); (2) the trimerization motif from the lung surfactant protein (Hoppe et al. 1994 FEB S Lett 344: 191-195); (3) collagen (McAlinden et al. 2003 Biol Chem 278:42200-42207); and (4) the phage T4 fibritin foldon (Miroshnikov et al. 1998 Protein Eng 11:329-414). In some embodiments, a foldon domain is linked to a F mutant at the C-terminus of F1 polypeptide. In specific embodiments, the foldon domain is a T4 fibritin foldon domain, such as the amino acid sequence GYIPEAPRDGQAYVRKDGEWVLLSTFL (SEQ ID NO: 40).

Typically, the multimerization domain is positioned C-terminal to the F1 polypeptide. It may join directly to the F1 polypeptide chain. Optionally, the multimerization domain is connected to the F1 polypeptide via a linker, such as an amino acid linker, for example the sequence GG, GS, or SAIG. The linker can also be a longer linker (for example, including the repeat sequence GG). Numerous conformationally neutral linkers are known in the art that can be used in the mutants provided by the present disclosure. In some embodiments, the F mutant comprising a foldon domain include a protease cleavage site for removing the foldon domain from the F1 polypeptide, such as a thrombin site between the F1 polypeptide and the foldon domain.

B-2. Introduced Mutations in the RSV F Protein Mutants

The RSV F mutants provided by the present disclosure comprise a F1 polypeptide and a F2 polypeptide, wherein (1) either the F1 polypeptide or (2) the F2 polypeptide, or (3) both the F1 polypeptide and F2 polypeptide include one or more introduced amino acid mutations relative to the amino acid sequence of the corresponding native F protein. The introduction of such amino acid mutations in the RSV F mutants may confer a beneficial property to the mutants, such as enhanced immunogenicity, improved stability, or formation or improved stability of certain desired physical form or conformation of the mutants. Such introduced amino acid mutations are referred to as "engineered disulfide bond mutations," "cavity filling mutations," or "electrostatic mutations," and are described in detail herein below. RSV F mutants that include any additional mutations are also encompassed by the invention so long as the immunogenic property of the mutants is not substantially adversely affected by the additional mutations.

B-2(a) Engineered Disulfide Bond Mutations

In some embodiments, RSV F mutants provided by the present disclosure include one or more engineered disulfide bond mutations. The term "engineered disulfide bond mutation" or "engineered disulfide mutation" refers to mutation of a pair of amino acid residues in a wild-type RSV F protein to a pair of cysteine residues. The introduced pair of cysteine residues allows for formation of a disulfide bond between the introduced cysteine residues, which disulfide bond serves to stabilize the protein's conformation or oligomeric state, such as pre-fusion conformation. For stabilizing the pre-fusion conformation of the mutant, the residue pairs for mutation to cysteine should be in close proximity in the pre-fusion conformation but distant in the post-fusion conformation. Such residues can be identified by suitable methods known in the art, such as by visual inspection of a crystal structure of RSV F in a pre-fusion conformation, or more quantitative selection using computational protein design software (such as BioLuminate™ [BioLuminate, Schrodinger LLC, New York, 2015], Discovery Studio™ [Discovery Studio Modeling Environment, Accelrys, San Diego, 2015], MOE™ [Molecular Operating Environment, Chemical Computing Group Inc., Montreal, 2015], and Rosetta™ [Rosetta, University of Washington, Seattle, 2015]). Preferably, the distance between the pair of residues (e.g. the beta carbons) is less than 8 Å in a pre-fusion conformation, but more than 20 Å in a post-fusion conformation.

In some embodiments, the RSV F protein mutants comprise only one engineered disulfide mutation ("single engineered disulfide mutation"). In some other embodiments, the RSV F protein mutants comprise at least two engineered disulfide mutations, wherein each pair of the cysteine residues of the engineered disulfide mutations are appropriately positioned when RSV F protein mutant is in pre-fusion conformation ("double engineered disulfide mutation").

In some specific embodiments, the present disclosure provides a RSV F mutant comprising at least one engineered disulfide bond mutation, wherein the mutant comprises the same introduced mutations that are in any of the exemplary mutants provided in Tables 1 and 4-6. The exemplary RSV F mutants provided in Tables 1 and 4-6 are based on the same native F0 sequence of RSV A2 strain with three naturally-occurring substitutions at positions 102, 379, and 447 (SEQ ID NO:3). The same introduced mutations in each of the mutants can be made to a native F0 polypeptide sequence of any other RSV subtype or strain to arrive at different RSV F mutants, such as a native F0 polypeptide sequence set forth in any of the SEQ ID NOs: 1, 2, 4, 6, and 81-270. RSV F mutants that are based on a native F0 polypeptide sequence of any other RSV subtype or strain and comprise any of the engineered disulfide mutations are also within the scope of the invention. In some particular embodiments, a RSV F protein mutant comprises at least one engineered disulfide mutation selected from the group consisting of: 55C and 188C; 155C and 290C; 103C and 148C; and 142C and 371C, such as S55C and L188C, S155C and S290C, T103C and I148C, or L142C and N371C.

In some embodiments, the present disclosure provides RSV F protein mutants, wherein the amino acid mutations are mutation of a pair of amino acid residues in the HRB region (approximately amino acids 476-524) of a RSV F protein to a pair of cysteines. The introduced pair of cysteine residues allows for formation of a disulfide bond between the cysteine residues from two adjacent F2-F1 mutant protomers of a trimer. The disulfide linking two protomers in a trimer serves to stabilize the mutant in a trimeric state. Examples of specific pairs of such mutations include: 508C and 509C; 515C and 516C; 522C and 523C, such as K508C and S509C, N515C and V516C, or T522C and T523C. In some embodiments, the RSV F mutants comprise (1) at least one pair of cysteine mutations in the HRB region and (2) at least one introduced mutation outside of the HRB region selected from an engineered disulfide bond mutation as described herein above, a cavity filling mutation as described herein below, an electrostatic mutation as described herein below, or a combination of any of these mutations.

B-2(b) Cavity Filling Mutations.

In other embodiments, the present disclosure provides RSV F mutants that comprise one or more cavity filling mutations. The term "cavity filling mutation" refers to the substitution of an amino acid residue in the wild-type RSV F protein by an amino acid that is expected to fill an internal cavity of the mature RSV F protein. In one application, such cavity-filling mutations contribute to stabilizing the pre-fusion conformation of a RSV F protein mutant. The cavities in the pre-fusion conformation of the RSV F protein can be identified by methods known in the art, such as by visual inspection of a crystal structure of RSV F in a pre-fusion conformation, or by using computational protein design software (such as BioLuminate™ [BioLuminate, Schrodinger LLC, New York, 2015], Discovery Studio™ [Discovery Studio Modeling Environment, Accelrys, San Diego, 2015], MOE™ [Molecular Operating Environment, Chemical Computing Group Inc., Montreal, 2015], and Rosetta™ [Rosetta, University of Washington, Seattle, 2015]). The amino acids to be replaced for cavity-filling mutations typically include small aliphatic (e.g. Gly, Ala, and Val) or small polar amino acids (e.g. Ser and Thr). They may also include amino acids that are buried in the pre-fusion conformation, but exposed to solvent in the post-conformation. The replacement amino acids can be large aliphatic amino acids (Ile, Leu and Met) or large aromatic amino acids (His, Phe, Tyr and Trp). For example, in several embodiments, the RSV F protein mutant includes a T54H mutation.

In some specific embodiments, the present disclosure provides a RSV F protein mutant that comprises one or more cavity filling mutations selected from the group consisting of:

1) substitution of the amino acid at position 55, 62, 155, 190, or 290 with I, Y, L, H, or M;

2) substitution of the amino acid at position 54, 58, 189, 219, or 397 with I, Y, L, H, or M;

3) substitution of the amino acid at position 151 with A or H;

4) substitution of the amino acid at position 147 or 298 with I, L, H, or M;

5) substitution of the amino acid at position 164, 187, 192, 207, 220, 296, 300, or 495 with I, Y, H; and 6) substitution of the amino acid at position 106 with W.

In some further specific embodiments, the RSV F protein mutant comprises one or more cavity filling mutations selected from the group consisting of:

1) substitution of Sat position 55, 62, 155, 190, or 290 with I, Y, L, H, or M;

2) substitution of T at position 54, 58, 189, 219, or 397 with I, Y, L, H, or M;

3) substitution of G at position 151 with A or H;

4) substitution of A at position 147 or 298 with I, L, H, or M;

5) substitution of V at position 164, 187, 192, 207, 220, 296, 300, or 495 with I, Y, H; and 6) substitution of R at position 106 with W.

In some specific embodiments, the present disclosure provides a RSV F mutant comprising one or more cavity filling mutations, wherein the mutant comprises the cavity filling mutations in any of the mutants provided in Tables 2, 4, and 6. RSV F mutants provided in Tables 2, 4, and 6 are based on the same native F0 sequence of RSV A2 strain with three naturally occurring substitutions at positions 102, 379, and 447 (SEQ ID NO:3). The same introduced mutations in each of the mutants can be made to a native F0 polypeptide sequence of any other RSV subtype or strain to arrive at different RSV F mutants, such as a native F0 polypeptide sequence set forth in any of the SEQ ID NOs:1, 2, 4, 6, and 81-270. The RSV F mutants that are based on a native F0 polypeptide sequence of any other RSV subtype or strain and comprise any of the one or more cavity filling mutations are also within the scope of the invention. In some particular embodiments, a RSV F protein mutant provided by the present disclosure comprises at least one cavity filling mutation selected from the group consisting of: T54H, S190I, and V296I.

B-2 (c) Electrostatic Mutations.

In still other embodiments, the present disclosure provides RSV F protein mutants that include one or more electrostatic mutations. The term "electrostatic mutation" refers to an amino acid mutation introduced to a wild-type RSV F protein that decreases ionic repulsion or increase ionic attraction between residues in a protein that are proximate to each other in the folded structure. As hydrogen bonding is a special case of ionic attraction, electrostatic mutations may increase hydrogen bonding between such proximate residues. In one example, an electrostatic mutation may be introduced to improve trimer stability. In some embodiments, an electrostatic mutation is introduced to decrease repulsive ionic interactions or increase attractive ionic interactions (potentially including hydrogen bonds) between residues that are in close proximity in the RSV F glycoprotein in its pre-fusion conformation but not in its post-fusion conformation. For example, in the pre-fusion conformation, the acidic side chain of Asp486 from one protomer of the RSV F glycoprotein trimer is located at the trimer interface and structurally sandwiched between two other acidic side chains of Glu487 and Asp489 from another protomer. On the other hand, in the post-fusion conformation, the acidic side chain of Asp486 is located on the trimer surface and exposed to solvent. In several embodiments, the RSV F protein mutant includes an electrostatic D486S substitution that reduces repulsive ionic interactions or increases attractive ionic interactions with acidic residues of Glu487 and Asp489 from another protomer of RSV F trimer. Introduction of an electrostatic mutation may increase the melting temperature (Tm) of the pre-fusion conformation or pre-fusion trimer conformation of the RSV F protein.

Unfavorable electrostatic interactions in a pre-fusion or pre-fusion trimer conformation can be identified by method known in the art, such as by visual inspection of a crystal structure of RSV F in a pre-fusion or pre-fusion trimer conformation, or by using computational protein design software (such as BioLuminate™ [BioLuminate, Schrodinger LLC, New York, 2015], Discovery Studio™ [Discovery Studio Modeling Environment, Accelrys, San Diego, 2015], MOE™ [Molecular Operating Environment, Chemical Computing Group Inc., Montreal, 2015.], and Rosetta™ [Rosetta, University of Washington, Seattle, 2015.])

In some specific embodiments, the RSV F protein mutant provided by the present disclosure comprises at least one electrostatic mutation selected from the group consisting of:
1) substitution of the amino acid at position 82, 92, or 487 by D, F, Q, T, S, L, or H;
2) substitution of the amino acid at position 315, 394, or 399 by F, M, R, S, L, I, Q, or T;
3) substitution of the amino acid at position 392, 486, or 489 by H, S, N, T, or P; and
4) substitution of the amino acid at position 106 or 339 by F, Q, N, or W.

In some further specific embodiments, the RSV F protein mutant comprises at least one electrostatic mutation selected from the group consisting of:
1) substitution of E at position 82, 92, or 487 by D, F, Q, T, S, L, or H;
2) substitution of K at position 315, 394, or 399 by F, M, R, S, L, I, Q, or T;
3) substitution of D at position 392, 486, or 489 by H, S, N, T, or P; and
4) substitution of R at position 106 or 339 by F, Q, N, or W.

In some specific embodiments, the present disclosure provides a RSV F mutant comprising one or more electrostatic mutations, wherein the mutant comprises the electrostatic mutations in any of the mutants provided in Tables 3, 5, and 6. RSV F mutants provided in Tables 3, 5, and 6 are based on the same native F0 sequence of RSV A2 strain with three naturally occurring substitutions at positions 102, 379, and 447 (SEQ ID NO:3). The same introduced mutations in each of the mutants can be made to a native F0 polypeptide sequence of any other RSV subtype or strain to arrive at different RSV F mutants, such as a native F0 polypeptide sequence set forth in any of the SEQ ID NOs:1, 2, 4, 6, and 81-270. RSV F mutants that are based on a native F0 polypeptide sequence of any other RSV subtype or strain and comprise any of the one or more electrostatic mutations are also within the scope of the invention. In some particular embodiments, the RSV F protein mutant comprises mutation D486S.

B-2 (d) Combination of Engineered Disulfide Bond Mutations, Cavity Filling Mutations, and Electrostatic Mutations.

In another aspect, the present disclosure provides RSV F protein mutants, which comprise a combination of two or more different types of mutations selected from engineered disulfide bond mutations, cavity filling mutations, and electrostatic mutations, each as described herein above.

In some embodiments, the mutants comprise at least one engineered disulfide bond mutation and at least one cavity filling mutation. In some specific embodiments, the RSV F mutants include a combination of mutations as noted in Table 4.

In some further embodiments, the RSV F protein mutants comprise at least one engineered disulfide mutation and at least one electrostatic mutation. In some specific embodiments, the RSV F mutants include a combination of mutations as noted in Table 5.

In still other embodiments, the RSV F protein mutants comprise at least one engineered disulfide mutation, at least one cavity filling mutation, and at least one electrostatic mutation. In some specific embodiments, the RSV F mutants include a combination of mutations as provided in Table 6.

In some particular embodiments, the present invention provides a RSV F mutant that comprises a combination of mutations selected from the group consisting of:

(1) combination of 103C, 148C, 190I, and 486S;
(2) combination of 54H, 55C, 188C, and 486S;
(3) combination of 54H, 103C, 148C, 190I, 296I, and 486S;
(4) combination of 54H, 55C, 142C, 188C, 296I, and 371C;
(5) combination of 55C, 188C, and 486S;
(6) combination of 54H, 55C, 188C, and 190I;
(7) combination of 55C, 188C, 190I, and 486S;
(8) combination of 54H, 55C, 188C, 190I, and 486S;
(9) combination of 155C, 190I, 290C, and 486S;
(10) combination of 54H, 55C, 142C, 188C, 296I, 371C, 486S, 487Q, and 489S; and
(11) combination of 54H, 155C, 190I, 290C, and 296I.

In some particular embodiments, the present invention provides a RSV F mutant that comprises a combination of mutations selected from the group consisting of:

(1) combination of T103C, I148C, S190I, and D486S;
(2) combination of T54H, S55C, L188C, and D486S;
(3) combination of T54H, T103C, I148C, S190I, V296I, and D486S;
(4) combination of T54H, S55C, L142C, L188C, V296I, and N371C;
(5) combination of S55C, L188C, and D486S;
(6) combination of T54H, S55C, L188C, and S190I;
(7) combination of S55C, L188C, S190I, and D486S;
(8) combination of T54H, S55C, L188C, S190I, and D486S;
(9) combination of S155C, S190I, S290C, and D486S;
(10) combination of T54H, S55C, L142C, L188C, V296I, N371C, D486S, E487Q, and D489S; and
(11) combination of T54H, S155C, S190I, S290C, and V296I.

In some specific embodiments, the present disclosure provides a RSV F mutant comprising a combination of introduced mutations, wherein the mutant comprises a combination of mutations in any of the mutants provided in Tables 4, 5, and 6. RSV F mutants provided in Tables 4, 5, and 6 are based on the same native F0 sequence of RSV A2 strain with three naturally occurring substitutions at positions 102, 379, and 447 (SEQ ID NO:3). The same introduced mutations in each of the mutants can be made to a native F0 polypeptide sequence of any other RSV subtype or strain to arrive at different RSV F mutants, such as a native F0 polypeptide sequence set forth in any of the SEQ ID NOs:1, 2, 4, 6, and 81-270. RSV F mutants that are based on a native F0 polypeptide sequence of any other RSV subtype or strain and comprise any of the combination of mutations are also within the scope of the invention.

In some other particular embodiments, the present invention provides a RSV F mutant, wherein the mutant comprises a cysteine (C) at position 103 (103C) and at position 148 (148C), an isoleucine (I) at position 190 (190I), and a serine (S) at position 486 (486S), and wherein the mutant comprises a F1 polypeptide and a F2 polypeptide selected from the group consisting of:

(1) a F2 polypeptide comprising the amino acid sequence of SEQ ID NO:41 and a F1 polypeptide comprising the amino acid sequence of SEQ ID NO:42;
(2) a F2 polypeptide comprising an amino acid sequence that is at least 97%, 98%, or 99% identical to the amino acid sequence of SEQ ID NO:41 and a F1 polypeptide comprising an amino acid sequence that is at least 97%, 98%, or 99% identical to the amino acid sequence of SEQ ID NO:42;
(3) a F2 polypeptide comprising the amino acid sequence of SEQ ID NO: 43 and a F1 polypeptide comprising the amino acid sequence of SEQ ID NO:44;

(4) a F2 polypeptide comprising an amino acid sequence that is at least 97%, 98%, or 99% identical to the amino acid sequence of SEQ ID NO:43 and a F1 polypeptide comprising an amino acid sequence that is at least 97%, 98%, or 99% identical to the amino acid sequence of SEQ ID NO:44;

(5) a F2 polypeptide comprising the amino acid sequence of SEQ ID NO: 45 and a F1 polypeptide comprising the amino acid sequence of SEQ ID NO:46;

(6) a F2 polypeptide comprising an amino acid sequence that is at least 97%, 98%, or 99% identical to the amino acid sequence of SEQ ID NO:45 and a F1 polypeptide comprising an amino acid sequence that is at least 97%, 98%, or 99% identical to the amino acid sequence of SEQ ID NO:46;

(7) a F2 polypeptide comprising the amino acid sequence of SEQ ID NO: 47 and a F1 polypeptide comprising the amino acid sequence of SEQ ID NO:48;

(8) a F2 polypeptide comprising an amino acid sequence that is at least 97%, 98%, or 99% identical to the amino acid sequence of SEQ ID NO:47 and a F1 polypeptide comprising an amino acid sequence that is at least 97%, 98%, or 99% identical to the amino acid sequence of SEQ ID NO:48;

(9) a F2 polypeptide comprising the amino acid sequence of SEQ ID NO: 49 and a F1 polypeptide comprising the amino acid sequence of SEQ ID NO:50;

(10) a F2 polypeptide comprising an amino acid sequence that is at least 97%, 98%, or 99% identical to the amino acid sequence of SEQ ID NO:49 and a F1 polypeptide comprising an amino acid sequence that is at least 97%, 98%, or 99% identical to the amino acid sequence of SEQ ID NO:50.

(11) a F2 polypeptide comprising the amino acid sequence of SEQ ID NO:279 and a F1 polypeptide comprising the amino acid sequence of SEQ ID NO:280;

(12) a F2 polypeptide comprising an amino acid sequence that is at least 97%, 98%, or 99% identical to the amino acid sequence of SEQ ID NO:279 and a F1 polypeptide comprising an amino acid sequence that is at least 97%, 98%, or 99% identical to the amino acid sequence of SEQ ID NO:280;

(13) a F2 polypeptide comprising the amino acid sequence of SEQ ID NO:281 and a F1 polypeptide comprising the amino acid sequence of SEQ ID NO:282;

(14) a F2 polypeptide comprising an amino acid sequence that is at least 97%, 98% or 99% identical to the amino acid sequence of SEQ ID NO:281 and a F1 polypeptide comprising an amino acid sequence that is at least 97%, 98%, or 99% identical to the amino acid sequence of SEQ ID NO:282;

(15) a F2 polypeptide comprising the amino acid sequence of SEQ ID NO:283 and a F1 polypeptide comprising the amino acid sequence of SEQ ID NO:284;

(16) a F2 polypeptide comprising an amino acid sequence that is at least 97%, 98%, or 99% identical to the amino acid sequence of SEQ ID NO:283 and a F1 polypeptide comprising an amino acid sequence that is at least 97%, 98%, or 99% identical to the amino acid sequence of SEQ ID NO:284;

(17) a F2 polypeptide comprising the amino acid sequence of SEQ ID NO:285 and a F1 polypeptide comprising the amino acid sequence of SEQ ID NO:286;

(18) a F2 polypeptide comprising an amino acid sequence that is at least 97%, 98%, or 99% identical to the amino acid sequence of SEQ ID NO:285 and a F1 polypeptide comprising an amino acid sequence that is at least 97%, 98%, or 99% identical to the amino acid sequence of SEQ ID NO:286;

(19) a F2 polypeptide comprising the amino acid sequence of SEQ ID NO:287 and a F1 polypeptide comprising the amino acid sequence of SEQ ID NO:288;

(20) a F2 polypeptide comprising an amino acid sequence that is at least 97%, 98%, or 99% identical to the amino acid sequence of SEQ ID NO:287 and a F1 polypeptide comprising an amino acid sequence that is at least 97%, 98%, or 99% identical to the amino acid sequence of SEQ ID NO:288;

(21) a F2 polypeptide comprising the amino acid sequence of SEQ ID NO:289 and a F1 polypeptide comprising the amino acid sequence of SEQ ID NO:290; and

(22) a F2 polypeptide comprising an amino acid sequence that is at least 97%, 98%, or 99% identical to the amino acid sequence of SEQ ID NO:289 and a F1 polypeptide comprising an amino acid sequence that is at least 97%, 98%, or 99% identical to the amino acid sequence of SEQ ID NO:290.

In some other particular embodiments, the present invention provides a RSV F mutant, wherein the mutant comprises a histidine (H) at position 54, a cysteine (C) at positions 103 and 148, a isoleucine (I) at positions 190 and 296, and a serine (S) at position 486, and wherein the mutant comprises a F1 polypeptide and a F2 polypeptide selected from the group consisting of:

(1) F2 polypeptide comprising the amino acid sequence of SEQ ID NO: 51 and a F1 polypeptide comprising the amino acid sequence of SEQ ID NO:52;

(2) a F2 polypeptide comprising an amino acid sequence that is at least 97%, 98%, or 99% identical to the amino acid sequence of SEQ ID NO:51 and a F1 polypeptide comprising an amino acid sequence that is at least 97%, 98%, or 99% identical to the amino acid sequence of SEQ ID NO:52;

(3) a F2 polypeptide comprising the amino acid sequence of SEQ ID NO:53 and a F1 polypeptide comprising the amino acid sequence of SEQ ID NO:54;

(4) a F2 polypeptide comprising an amino acid sequence that is at least 97%, 98%, or 99% identical to the amino acid sequence of SEQ ID NO:53 and a F1 polypeptide comprising an amino acid sequence that is at least 97%, 98%, or 99% identical to the amino acid sequence of SEQ ID NO:54;

(5) a F2 polypeptide comprising the amino acid sequence of SEQ ID NO:55 and a F1 polypeptide comprising the amino acid sequence of SEQ ID NO:56;

(6) a F2 polypeptide comprising an amino acid sequence that is at least 97%, 98%, or 99% identical to the amino acid sequence of SEQ ID NO:55 and a F1 polypeptide comprising an amino acid sequence that is at least 97%, 98%, or 99% identical to the amino acid sequence of SEQ ID NO:56;

(7) a F2 polypeptide comprising the amino acid sequence of SEQ ID NO:57 and a F1 polypeptide comprising the amino acid sequence of SEQ ID NO:58;

(8) a F2 polypeptide comprising an amino acid sequence that is at least 97%, 98%, or 99% identical to the amino acid sequence of SEQ ID NO:57 and a F1 polypeptide comprising an amino acid sequence that is at least 97%, 98%, or 99% identical to the amino acid sequence of SEQ ID NO:58;

(9) a F2 polypeptide comprising the amino acid sequence of SEQ ID NO:59 and a F1 polypeptide comprising the amino acid sequence of SEQ ID NO:60;

(10) a F2 polypeptide comprising an amino acid sequence that is at least 97%, 98%, or 99% identical to the amino acid sequence of SEQ ID NO:59 and a F1 polypeptide comprising an amino acid sequence that is at least 97%, 98%, or 99% identical to the amino acid sequence of SEQ ID NO:60;

(11) a F2 polypeptide comprising the amino acid sequence of SEQ ID NO:291 and a F1 polypeptide comprising the amino acid sequence of SEQ ID NO:292;

(12) a F2 polypeptide comprising an amino acid sequence that is at least 97%, 98%, or 99% identical to the amino acid sequence of SEQ ID NO:291 and a F1 polypeptide comprising an amino acid sequence that is at least 97%, 98%, or 99% identical to the amino acid sequence of SEQ ID NO:292;

(13) a F2 polypeptide comprising the amino acid sequence of SEQ ID NO:293 and a F1 polypeptide comprising the amino acid sequence of SEQ ID NO:294;

(14) a F2 polypeptide comprising an amino acid sequence that is at least 97%, 98%, or 99% identical to the amino acid sequence of SEQ ID NO:293 and a F1 polypeptide comprising an amino acid sequence that is at least 97%, 98%, or 99% identical to the amino acid sequence of SEQ ID NO:294;

(15) a F2 polypeptide comprising the amino acid sequence of SEQ ID NO:295 and a F1 polypeptide comprising the amino acid sequence of SEQ ID NO:296;

(16) a F2 polypeptide comprising an amino acid sequence that is at least 97%, 98%, or 99% identical to the amino acid sequence of SEQ ID NO:295 and a F1 polypeptide comprising an amino acid sequence that is at least 97%, 98%, or 99% identical to the amino acid sequence of SEQ ID NO:296;

(17) a F2 polypeptide comprising the amino acid sequence of SEQ ID NO:297 and a F1 polypeptide comprising the amino acid sequence of SEQ ID NO:298;

(18) a F2 polypeptide comprising an amino acid sequence that is at least 97%, 98%, or 99% identical to the amino acid sequence of SEQ ID NO:297 and a F1 polypeptide comprising an amino acid sequence that is at least 97%, 98%, or 99% identical to the amino acid sequence of SEQ ID NO:298;

(19) a F2 polypeptide comprising the amino acid sequence of SEQ ID NO:299 and a F1 polypeptide comprising the amino acid sequence of SEQ ID NO:300;

(20) a F2 polypeptide comprising an amino acid sequence that is at least 97%, 98%, or 99% identical to the amino acid sequence of SEQ ID NO:299 and a F1 polypeptide comprising an amino acid sequence that is at least 97%, 98%, or 99% identical to the amino acid sequence of SEQ ID NO:300;

(21) a F2 polypeptide comprising the amino acid sequence of SEQ ID NO:301 and a F1 polypeptide comprising the amino acid sequence of SEQ ID NO:302; and

(22) a F2 polypeptide comprising an amino acid sequence that is at least 97%, 98%, or 99% identical to the amino acid sequence of SEQ ID NO:301 and a F1 polypeptide comprising an amino acid sequence that is at least 97%, 98%, or 99% identical to the amino acid sequence of SEQ ID NO:302.

In some other particular embodiments, the present invention provides a RSV F mutant, wherein the mutant comprises a histidine (H) at position 54, a cysteine (C) at positions 55 and 188, and a serine (S) at position 486, and wherein the mutant comprises a F1 polypeptide and a F2 polypeptide selected from the group consisting of:

(1) a F2 polypeptide comprising the amino acid sequence of SEQ ID NO:61 and a F1 polypeptide comprising the amino acid sequence of SEQ ID NO:62;

(2) a F2 polypeptide comprising an amino acid sequence that is at least 97%, 98% or 99% identical to the amino acid sequence of SEQ ID NO:61 and a F1 polypeptide comprising an amino acid sequence that is at least 97%, 98%, or 99% identical to the amino acid sequence of SEQ ID NO:62;

(3) a F2 polypeptide comprising the amino acid sequence of SEQ ID NO:63 and a F1 polypeptide comprising the amino acid sequence of SEQ ID NO:64;

(4) a F2 polypeptide comprising an amino acid sequence that is at least 97%, 98%, or 99% identical to the amino acid sequence of SEQ ID NO:63 and a F1 polypeptide comprising an amino acid sequence that is at least 97%, 98%, or 99% identical to the amino acid sequence of SEQ ID NO:64;

(5) a F2 polypeptide comprising the amino acid sequence of SEQ ID NO:65 and a F1 polypeptide comprising the amino acid sequence of SEQ ID NO:66;

(6) a F2 polypeptide comprising an amino acid sequence that is at least 97%, 98%, or 99% identical to the amino acid sequence of SEQ ID NO:65 and a F1 polypeptide comprising an amino acid sequence that is at least 97%, 98%, or 99% identical to the amino acid sequence of SEQ ID NO:66;

(7) a F2 polypeptide comprising the amino acid sequence of SEQ ID NO:67 and a F1 polypeptide comprising the amino acid sequence of SEQ ID NO:68;

(8) a F2 polypeptide comprising an amino acid sequence that is at least 97%, 98%, or 99% identical to the amino acid sequence of SEQ ID NO:67 and a F1 polypeptide comprising an amino acid sequence that is at least 97%, 98%, or 99% identical to the amino acid sequence of SEQ ID NO:68;

(9) a F2 polypeptide comprising the amino acid sequence of SEQ ID NO:69 and a F1 polypeptide comprising the amino acid sequence of SEQ ID NO:70;

(10) a F2 polypeptide comprising an amino acid sequence that is at least 97%, 98%, or 99% identical to the amino acid sequence of SEQ ID NO:69 and a F1 polypeptide comprising an amino acid sequence that is at least 97%, 98%, or 99% identical to the amino acid sequence of SEQ ID NO:70;

(11) a F2 polypeptide comprising the amino acid sequence of SEQ ID NO:303 and a F1 polypeptide comprising the amino acid sequence of SEQ ID NO:304;

(12) a F2 polypeptide comprising an amino acid sequence that is at least 97%, 98%, or 99% identical to the amino acid sequence of SEQ ID NO:303 and a F1 polypeptide comprising an amino acid sequence that is at least 97%, 98%, or 99% identical to the amino acid sequence of SEQ ID NO:304;

(13) a F2 polypeptide comprising the amino acid sequence of SEQ ID NO:305 and a F1 polypeptide comprising the amino acid sequence of SEQ ID NO:306;

(14) a F2 polypeptide comprising an amino acid sequence that is at least 97%, 98%, or 99% identical to the amino acid sequence of SEQ ID NO:305 and a F1 polypeptide comprising an amino acid sequence that is at least 97%, 98%, or 99% identical to the amino acid sequence of SEQ ID NO:306;

(15) a F2 polypeptide comprising the amino acid sequence of SEQ ID NO:307 and a F1 polypeptide comprising the amino acid sequence of SEQ ID NO:308;

(16) a F2 polypeptide comprising an amino acid sequence that is at least 97%, 98%, or 99% identical to the amino acid sequence of SEQ ID NO:307 and a F1 polypeptide comprising an amino acid sequence that is at least 97%, 98%, or 99% identical to the amino acid sequence of SEQ ID NO:308;

(17) a F2 polypeptide comprising the amino acid sequence of SEQ ID NO:309 and a F1 polypeptide comprising the amino acid sequence of SEQ ID NO:310;

(18) a F2 polypeptide comprising an amino acid sequence that is at least 97%, 98%, or 99% identical to the amino acid sequence of SEQ ID NO:309 and a F1 polypeptide comprising an amino acid sequence that is at least 97%, 98%, or 99% identical to the amino acid sequence of SEQ ID NO:310;

(19) a F2 polypeptide comprising the amino acid sequence of SEQ ID NO:311 and a F1 polypeptide comprising the amino acid sequence of SEQ ID NO:312;

(20) a F2 polypeptide comprising an amino acid sequence that is at least 97%, 98%, or 99% identical to the amino acid sequence of SEQ ID NO:311 and a F1 polypeptide comprising an amino acid sequence that is at least 97%, 98%, or 99% identical to the amino acid sequence of SEQ ID NO:312.

(21) a F2 polypeptide comprising the amino acid sequence of SEQ ID NO:313 and a F1 polypeptide comprising the amino acid sequence of SEQ ID NO:314; and

(22) a F2 polypeptide comprising an amino acid sequence that is at least 97%, 98%, or 99% identical to the amino acid sequence of SEQ ID NO:313 and a F1 polypeptide comprising an amino acid sequence that is at least 97%, 98%, or 99% identical to the amino acid sequence of SEQ ID NO:314.

In some other particular embodiments, the present invention provides a RSV F mutant, wherein the mutant comprises a histidine (H) at position 54, a cysteine (C) at positions 55 and 188, an isoleucine (I) at position 190 (190I), and a serine (S) at position 486, and wherein the mutant comprises a F1 polypeptide and a F2 polypeptide selected from the group consisting of:

(1) a F2 polypeptide comprising the amino acid sequence of SEQ ID NO:71 and a F1 polypeptide comprising the amino acid sequence of SEQ ID NO:72;

(2) a F2 polypeptide comprising an amino acid sequence that is at least 97%, 98%, or 99% identical to the amino acid sequence of SEQ ID NO:71 and a F1 polypeptide comprising an amino acid sequence that is at least 97%, 98%, or 99% identical to the amino acid sequence of SEQ ID NO:72;

(3) a F2 polypeptide comprising the amino acid sequence of SEQ ID NO:73 and a F1 polypeptide comprising the amino acid sequence of SEQ ID NO:74;

(4) a F2 polypeptide comprising an amino acid sequence that is at least 97%, 98%, or 99% identical to the amino acid sequence of SEQ ID NO:73 and a F1 polypeptide comprising an amino acid sequence that is at least 97%, 98%, or 99% identical to the amino acid sequence of SEQ ID NO:74;

(5) a F2 polypeptide comprising the amino acid sequence of SEQ ID NO:75 and a F1 polypeptide comprising the amino acid sequence of SEQ ID NO:76;

(6) a F2 polypeptide comprising an amino acid sequence that is at least 97%, 98%, or 99% identical to the amino acid sequence of SEQ ID NO:75 and a F1 polypeptide comprising an amino acid sequence that is at least 97%, 98%, or 99% identical to the amino acid sequence of SEQ ID NO:76;

(7) a F2 polypeptide comprising the amino acid sequence of SEQ ID NO:77 and a F1 polypeptide comprising the amino acid sequence of SEQ ID NO:78;

(8) a F2 polypeptide comprising an amino acid sequence that is at least 97%, 98%, or 99% identical to the amino acid sequence of SEQ ID NO:77 and a F1 polypeptide comprising an amino acid sequence that is at least 97%, 98%, or 99% identical to the amino acid sequence of SEQ ID NO:78;

(9) a F2 polypeptide comprising the amino acid sequence of SEQ ID NO:79 and a F1 polypeptide comprising the amino acid sequence of SEQ ID NO:80;

(10) a F2 polypeptide comprising an amino acid sequence that is at least 97%, 98%, or 99% identical to the amino acid sequence of SEQ ID NO:79 and a F1 polypeptide comprising an amino acid sequence that is at least 97%, 98%, or 99% identical to the amino acid sequence of SEQ ID NO:80;

(11) a F2 polypeptide comprising the amino acid sequence of SEQ ID NO:315 and a F1 polypeptide comprising the amino acid sequence of SEQ ID NO:316;

(12) a F2 polypeptide comprising an amino acid sequence that is at least 97%, 98%, or 99% identical to the amino acid sequence of SEQ ID NO:315 and a F1 polypeptide comprising an amino acid sequence that is at least 97%, 98%, or 99% identical to the amino acid sequence of SEQ ID NO:316;

(13) a F2 polypeptide comprising the amino acid sequence of SEQ ID NO:317 and a F1 polypeptide comprising the amino acid sequence of SEQ ID NO:318;

(14) a F2 polypeptide comprising an amino acid sequence that is at least 97%, 98%, or 99% identical to the amino acid sequence of SEQ ID NO:317 and a F1 polypeptide comprising an amino acid sequence that is at least 97%, 98%, or 99% identical to the amino acid sequence of SEQ ID NO:318;

(15) a F2 polypeptide comprising the amino acid sequence of SEQ ID NO:319 and a F1 polypeptide comprising the amino acid sequence of SEQ ID NO:320;

(16) a F2 polypeptide comprising an amino acid sequence that is at least 97%, 98%, or 99% identical to the amino acid sequence of SEQ ID NO:319 and a F1 polypeptide comprising an amino acid sequence that is at least 97%, 98%, or 99% identical to the amino acid sequence of SEQ ID NO:320;

(17) a F2 polypeptide comprising the amino acid sequence of SEQ ID NO:321 and a F1 polypeptide comprising the amino acid sequence of SEQ ID NO:322;

(18) a F2 polypeptide comprising an amino acid sequence that is at least 97%, 98%, or 99% identical to the amino acid sequence of SEQ ID NO:321 and a F1 polypeptide comprising an amino acid sequence that is at least 97%, 98%, or 99% identical to the amino acid sequence of SEQ ID NO:322;

(19) a F2 polypeptide comprising the amino acid sequence of SEQ ID NO:323 and a F1 polypeptide comprising the amino acid sequence of SEQ ID NO:324;

(20) a F2 polypeptide comprising an amino acid sequence that is at least 97%, 98%, or 99% identical to the amino acid sequence of SEQ ID NO:323 and a F1 polypeptide comprising an amino acid sequence that is at least 97%, 98%, or 99% identical to the amino acid sequence of SEQ ID NO:324.

(21) a F2 polypeptide comprising the amino acid sequence of SEQ ID NO:325 and a F1 polypeptide comprising the amino acid sequence of SEQ ID NO:326; and

(22) a F2 polypeptide comprising an amino acid sequence that is at least 97%, 98%, or 99% identical to the amino acid sequence of SEQ ID NO:325 and a F1 polypeptide comprising an amino acid sequence that is at least 97%, 98%, or 99% identical to the amino acid sequence of SEQ ID NO:326.

The amino acid sequence of the F2 polypeptide and F1 polypeptide of exemplary RSV F mutants provided by the present disclosure is provided in Tables C-F.

In several embodiments, a foldon domain is linked to a RSV F mutant described herein above, wherein the foldon domain is linked to the C-terminus of the F1 polypeptide and comprises the amino acid sequence of SEQ ID NO:40.

The RSV F protein mutants provided by the present disclosure can be prepared by routine methods known in the art, such as by expression in a recombinant host system using a suitable vector. Suitable recombinant host cells include, for example, insect cells, mammalian cells, avian cells, bacteria, and yeast cells. Examples of suitable insect cells include, for example, Sf9 cells, Sf21 cells, Tn5 cells, Schneider S2 cells, and High Five cells (a clonal isolate derived from the parental Trichoplusia ni BTI-TN-5B1-4 cell line (Invitrogen)). Examples of suitable mammalian cells include Chinese hamster ovary (CHO) cells, human embryonic kidney cells (HEK293 or Expi 293 cells, typically transformed by sheared adenovirus type 5 DNA), NIH-3T3 cells, 293-T cells, Vero cells, and HeLa cells. Suitable avian cells include, for example, chicken embryonic stem cells (e.g., EBx® cells), chicken embryonic fibroblasts, chicken embryonic germ cells, quail fibroblasts (e.g. ELL-O), and duck cells. Suitable insect cell expression systems, such as baculovirus-vectored systems, are known to those of skill in the art and described in, e.g., Summers and Smith, Texas Agricultural Experiment Station Bulletin No. 1555 (1987). Materials and methods for baculovirus/insect cell expression systems are commercially available in kit form from, inter alia, Invitrogen, San Diego Calif. Avian cell expression systems are also known to those of skill in the art and described in, e.g., U.S. Pat. Nos. 5,340,740; 5,656,479; 5,830,510; 6,114,168; and 6,500,668. Similarly, bacterial and mammalian cell expression systems are also known in the art and described in, e.g., Yeast Genetic Engineering (Barr et al., eds., 1989) Butterworths, London.

A number of suitable vectors for expression of recombinant proteins in insect or mammalian cells are well-known and conventional in the art. Suitable vectors can contain a number of components, including, but not limited to one or more of the following: an origin of replication; a selectable marker gene; one or more expression control elements, such as a transcriptional control element (e.g., a promoter, an enhancer, a terminator), and/or one or more translation signals; and a signal sequence or leader sequence for targeting to the secretory pathway in a selected host cell (e.g., of mammalian origin or from a heterologous mammalian or non-mammalian species). For example, for expression in insect cells a suitable baculovirus expression vector, such as pFastBac (Invitrogen), is used to produce recombinant baculovirus particles. The baculovirus particles are amplified and used to infect insect cells to express recombinant protein. For expression in mammalian cells, a vector that will drive expression of the construct in the desired mammalian host cell (e.g., Chinese hamster ovary cells) is used.

The RSV F protein mutant polypeptides can be purified using any suitable methods. For example, methods for purifying RSV F protein mutant polypeptides by immunoaffinity chromatography are known in the art. Ruiz-Arguello et al., J. Gen. Virol., 85:3677-3687 (2004). Suitable methods for purifying desired proteins including precipitation and various types of chromatography, such as hydrophobic interaction, ion exchange, affinity, chelating and size exclusion are well-known in the art. Suitable purification schemes can be created using two or more of these or other suitable methods. If desired, the RSV F protein mutant polypeptides can include a "tag" that facilitates purification, such as an epitope tag or a histidine (HIS) tag. Such tagged polypeptides can conveniently be purified, for example from conditioned media, by chelating chromatography or affinity chromatography.

C. NUCLEIC ACIDS ENCODING RSV F PROTEIN MUTANTS

In another aspect, the present invention provides nucleic acid molecules that encode a RSV F protein mutant described herein above. These nucleic acid molecules include DNA, cDNA, and RNA sequences. Nucleic acid molecules that encode only a F2 polypeptide or only a F1 polypeptide of a RSV F mutant are also encompassed by the invention. The nucleic acid molecule can be incorporated into a vector, such as an expression vector.

In some embodiments, the nucleic acid molecule encodes a precursor F0 polypeptide that, when expressed in an appropriate cell, is processed into a disclosed RSV F mutant. In some embodiments, the nucleic acid molecule encodes a precursor F0 polypeptide that, when expressed in an appropriate cell, is processed into a disclosed RSV F mutant, wherein the precursor F0 polypeptide includes, from N- to C-terminus, a signal peptide, a F2 polypeptide, a Pep27 polypeptide, and a F1 polypeptide. In some embodiments, the Pep27 polypeptide comprises the amino acid sequence set forth at positions 110-136 of any of the amino acid sequences of SEQ ID NOs:1, 2, 4, 6, and 81-270, wherein the amino acid positions correspond to the amino acid sequence of SEQ ID NO:1. In some embodiments, the signal peptide comprises the amino acid sequence set forth at positions 1-25 of any one of the amino acid sequences of SEQ ID NOs: 1, 2, 4, 6, and 81-270, wherein the amino acid positions correspond to the amino acid sequence of a reference of SEQ ID NO:1.

In some embodiments, the nucleic acid molecule encodes a mutant selected from the group consisting of:

(1) a mutant comprising at least one engineered disulfide mutation;

(2) a mutant comprising at least one cavity filing mutation;

(3) a mutant comprising at least one electrostatic mutation;

(4) a mutant comprising at least one engineered disulfide mutation and at least one cavity filing mutation;

(5) a mutant comprising at least one engineered disulfide mutation and at least one electrostatic mutation;

(6) a mutant comprising at least one cavity filing mutation and at least one electrostatic mutation; and (7) a mutant comprising at least one engineered disulfide mutation and at least one electrostatic mutation, at least one cavity filing mutation, and at least one electrostatic mutation.

In some specific embodiments, the present disclosure provides a nucleic acid molecule which encodes a mutant selected from the group consisting of:

(1) a mutant comprising a combination of substitutions 103C, 148C, 190I, and 486S;

(2) a mutant comprising a combination of substitutions 54H, 55C, 188C, and 486S;

(3) a mutant comprising a combination of substitutions 54H, 103C, 148C, 190I, 296I, and 486S;

(4) a mutant comprising a combination of substitutions 54H, 55C, 142C, 188C, 296I, and 371C;

(5) a mutant comprising a combination of amino acid substitutions 55C, 188C, and 486S;

(6) a mutant comprising a combination of amino acid substitutions 54H, 55C, 188C, and 190I;

(7) a mutant comprising a combination of amino acid substitutions 55C, 188C, 190I, and 486S;

(8) a mutant comprising a combination of amino acid substitutions 54H, 55C, 188C, 190I, and 486S;

(9) a mutant comprising a combination of amino acid substitutions 155C, 190I, 290C, and 486S;

(10) a mutant comprising a combination of amino acid substitutions 54H, 55C, 142C, 188C, 296I, 371C, 486S, 487Q, and 489S; and

(11) a mutant comprising a combination of amino acid substitutions 54H, 155C, 190I, 290C, and 296I.

In some particular embodiments, the nucleic acid molecule encodes a RSV F mutant, wherein the mutant comprises a cysteine (C) at position 103 (103C) and at position 148 (148C), an isoleucine (I) at position 190 (190I), and a serine (S) at position 486 (486S), and wherein the mutant comprises a F1 polypeptide and a F2 polypeptide selected from the group consisting of:

(1) a F2 polypeptide comprising the amino acid sequence of SEQ ID NO:41 and a F1 polypeptide comprising the amino acid sequence of SEQ ID NO:42;

(2) a F2 polypeptide comprising an amino acid sequence that is at least 97%, 98%, or 99% identical to the amino acid sequence of SEQ ID NO:41 and a F1 polypeptide comprising an amino acid sequence that is at least 97%, 98%, or 99% identical to the amino acid sequence of SEQ ID NO:42;

(3) a F2 polypeptide comprising the amino acid sequence of SEQ ID NO: 43 and a F1 polypeptide comprising the amino acid sequence of SEQ ID NO:44;

(4) a F2 polypeptide comprising an amino acid sequence that is at least 97%, 98%, or 99% identical to the amino acid sequence of SEQ ID NO:43 and a F1 polypeptide comprising an amino acid sequence that is at least 97%, 98%, or 99% identical to the amino acid sequence of SEQ ID NO:44;

(5) a F2 polypeptide comprising the amino acid sequence of SEQ ID NO: 45 and a F1 polypeptide comprising the amino acid sequence of SEQ ID NO:46;

(6) a F2 polypeptide comprising an amino acid sequence that is at least 97%, 98%, or 99% identical to the amino acid sequence of SEQ ID NO:45 and a F1 polypeptide comprising an amino acid sequence that is at least 97%, 98%, or 99% identical to the amino acid sequence of SEQ ID NO:46;

(7) a F2 polypeptide comprising the amino acid sequence of SEQ ID NO: 47 and a F1 polypeptide comprising the amino acid sequence of SEQ ID NO:48;

(8) a F2 polypeptide comprising an amino acid sequence that is at least 97%, 98%, or 99% identical to the amino acid sequence of SEQ ID NO:47 and a F1 polypeptide comprising an amino acid sequence that is at least 97%, 98%, or 99% identical to the amino acid sequence of SEQ ID NO:48;

(9) a F2 polypeptide comprising the amino acid sequence of SEQ ID NO: 49 and a F1 polypeptide comprising the amino acid sequence of SEQ ID NO:50;

(10) a F2 polypeptide comprising an amino acid sequence that is at least 97%, 98%, or 99% identical to the amino acid sequence of SEQ ID NO:49 and a F1 polypeptide comprising an amino acid sequence that is at least 97%, 98%, or 99% identical to the amino acid sequence of SEQ ID NO:50.

(11) a F2 polypeptide comprising the amino acid sequence of SEQ ID NO:279 and a F1 polypeptide comprising the amino acid sequence of SEQ ID NO:280;

(12) a F2 polypeptide comprising an amino acid sequence that is at least 97%, 98%, or 99% identical to the amino acid sequence of SEQ ID NO:279 and a F1 polypeptide comprising an amino acid sequence that is at least 97%, 98%, or 99% identical to the amino acid sequence of SEQ ID NO:280;

(13) a F2 polypeptide comprising the amino acid sequence of SEQ ID NO:281 and a F1 polypeptide comprising the amino acid sequence of SEQ ID NO:282;

(14) a F2 polypeptide comprising an amino acid sequence that is at least 97%, 98%, or 99% identical to the amino acid sequence of SEQ ID NO:281 and a F1 polypeptide comprising an amino acid sequence that is at least 97%, 98%, or 99% identical to the amino acid sequence of SEQ ID NO:282;

(15) a F2 polypeptide comprising the amino acid sequence of SEQ ID NO:283 and a F1 polypeptide comprising the amino acid sequence of SEQ ID NO:284;

(16) a F2 polypeptide comprising an amino acid sequence that is at least 97%, 98%, or 99% identical to the amino acid sequence of SEQ ID NO:283 and a F1 polypeptide comprising an amino acid sequence that is at least 97%, 98%, or 99% identical to the amino acid sequence of SEQ ID NO:284;

(17) a F2 polypeptide comprising the amino acid sequence of SEQ ID NO:285 and a F1 polypeptide comprising the amino acid sequence of SEQ ID NO:286;

(18) a F2 polypeptide comprising an amino acid sequence that is at least 97%, 98%, or 99% identical to the amino acid sequence of SEQ ID NO:285 and a F1 polypeptide comprising an amino acid sequence that is at least 97%, 98%, or 99% identical to the amino acid sequence of SEQ ID NO:286;

(19) a F2 polypeptide comprising the amino acid sequence of SEQ ID NO:287 and a F1 polypeptide comprising the amino acid sequence of SEQ ID NO:288;

(20) a F2 polypeptide comprising an amino acid sequence that is at least 97%, 98%, or 99% identical to the amino acid sequence of SEQ ID NO:287 and a F1 polypeptide comprising an amino acid sequence that is at least 97%, 98%, or 99% identical to the amino acid sequence of SEQ ID NO:288;

(21) a F2 polypeptide comprising the amino acid sequence of SEQ ID NO:289 and a F1 polypeptide comprising the amino acid sequence of SEQ ID NO:290; and

(22) a F2 polypeptide comprising an amino acid sequence that is at least 97%, 98%, or 99% identical to the amino acid sequence of SEQ ID NO:289 and a F1 polypeptide comprising an amino acid sequence that is at least 97%, 98%, or 99% identical to the amino acid sequence of SEQ ID NO:290.

In some other particular embodiments, the nucleic acid molecule encodes a RSV F mutant, wherein the mutant comprises a histidine (H) at position 54, a cysteine (C) at positions 103 and 148, a isoleucine (I) at positions 190 and 296, and a serine (S) at position 486, and wherein the mutant comprises a F1 polypeptide and a F2 polypeptide selected from the group consisting of:

(1) F2 polypeptide comprising the amino acid sequence of SEQ ID NO: 51 and a F1 polypeptide comprising the amino acid sequence of SEQ ID NO:52;

(2) a F2 polypeptide comprising an amino acid sequence that is at least 97%, 98%, or 99% identical to the amino acid sequence of SEQ ID NO:51 and a F1 polypeptide comprising an amino acid sequence that is at least 97%, 98%, or 99% identical to the amino acid sequence of SEQ ID NO:52;

(3) a F2 polypeptide comprising the amino acid sequence of SEQ ID NO:53 and a F1 polypeptide comprising the amino acid sequence of SEQ ID NO:54;

(4) a F2 polypeptide comprising an amino acid sequence that is at least 97%, 98%, or 99% identical to the amino acid sequence of SEQ ID NO:53 and a F1 polypeptide comprising an amino acid sequence that is at least 97%, 98%, or 99% identical to the amino acid sequence of SEQ ID NO:54;

(5) a F2 polypeptide comprising the amino acid sequence of SEQ ID NO:55 and a F1 polypeptide comprising the amino acid sequence of SEQ ID NO:56;

(6) a F2 polypeptide comprising an amino acid sequence that is at least 97%, 98%, or 99% identical to the amino acid sequence of SEQ ID NO:55 and a F1 polypeptide comprising an amino acid sequence that is at least 97%, 98%, or 99% identical to the amino acid sequence of SEQ ID NO:56;

(7) a F2 polypeptide comprising the amino acid sequence of SEQ ID NO:57 and a F1 polypeptide comprising the amino acid sequence of SEQ ID NO:58;

(8) a F2 polypeptide comprising an amino acid sequence that is at least 97%, 98%, or 99% identical to the amino acid sequence of SEQ ID NO:57 and a F1 polypeptide comprising an amino acid sequence that is at least 97%, 98%, or 99% identical to the amino acid sequence of SEQ ID NO:58;

(9) a F2 polypeptide comprising the amino acid sequence of SEQ ID NO:59 and a F1 polypeptide comprising the amino acid sequence of SEQ ID NO:60;

(10) a F2 polypeptide comprising an amino acid sequence that is at least 97%, 98%, or 99% identical to the amino acid sequence of SEQ ID NO:59 and a F1 polypeptide comprising an amino acid sequence that is at least 97%, 98%, or 99% identical to the amino acid sequence of SEQ ID NO:60;

(11) a F2 polypeptide comprising the amino acid sequence of SEQ ID NO:291 and a F1 polypeptide comprising the amino acid sequence of SEQ ID NO:292;

(12) a F2 polypeptide comprising an amino acid sequence that is at least 97%, 98%, or 99% identical to the amino acid sequence of SEQ ID NO:291 and a F1 polypeptide comprising an amino acid sequence that is at least 97%, 98%, or 99% identical to the amino acid sequence of SEQ ID NO:292;

(13) a F2 polypeptide comprising the amino acid sequence of SEQ ID NO:293 and a F1 polypeptide comprising the amino acid sequence of SEQ ID NO:294;

(14) a F2 polypeptide comprising an amino acid sequence that is at least 97%, 98%, or 99% identical to the amino acid sequence of SEQ ID NO:293 and a F1 polypeptide comprising an amino acid sequence that is at least 97%, 98%, or 99% identical to the amino acid sequence of SEQ ID NO:294;

(15) a F2 polypeptide comprising the amino acid sequence of SEQ ID NO:295 and a F1 polypeptide comprising the amino acid sequence of SEQ ID NO:296;

(16) a F2 polypeptide comprising an amino acid sequence that is at least 97%, 98%, or 99% identical to the amino acid sequence of SEQ ID NO:295 and a F1 polypeptide comprising an amino acid sequence that is at least 97%, 98%, or 99% identical to the amino acid sequence of SEQ ID NO:296;

(17) a F2 polypeptide comprising the amino acid sequence of SEQ ID NO:297 and a F1 polypeptide comprising the amino acid sequence of SEQ ID NO:298;

(18) a F2 polypeptide comprising an amino acid sequence that is at least 97%, 98%, or 99% identical to the amino acid sequence of SEQ ID NO:297 and a F1 polypeptide comprising an amino acid sequence that is at least 97%, 98%, or 99% identical to the amino acid sequence of SEQ ID NO:298;

(19) a F2 polypeptide comprising the amino acid sequence of SEQ ID NO:299 and a F1 polypeptide comprising the amino acid sequence of SEQ ID NO:300;

(20) a F2 polypeptide comprising an amino acid sequence that is at least 97%, 98%, or 99% identical to the amino acid sequence of SEQ ID NO:299 and a F1 polypeptide comprising an amino acid sequence that is at least 97%, 98%, or 99% identical to the amino acid sequence of SEQ ID NO:300;

(21) a F2 polypeptide comprising the amino acid sequence of SEQ ID NO:301 and a F1 polypeptide comprising the amino acid sequence of SEQ ID NO:302; and

(22) a F2 polypeptide comprising an amino acid sequence that is at least 97%, 98% or 99% identical to the amino acid sequence of SEQ ID NO:301 and a F1 polypeptide comprising an amino acid sequence that is at least 97%, 98%, or 99% identical to the amino acid sequence of SEQ ID NO:302.

In some other particular embodiments, the nucleic acid molecule encodes a RSV F mutant, wherein the mutant comprises a histidine (H) at position 54, a cysteine (C) at positions 55 and 188, and a serine (S) at position 486, and wherein the mutant comprises a F1 polypeptide and a F2 polypeptide selected from the group consisting of:

(1) a F2 polypeptide comprising the amino acid sequence of SEQ ID NO:61 and a F1 polypeptide comprising the amino acid sequence of SEQ ID NO:62;

(2) a F2 polypeptide comprising an amino acid sequence that is at least 97%, 98%, or 99% identical to the amino acid sequence of SEQ ID NO:61 and a F1 polypeptide comprising an amino acid sequence that is at least 97%, 98%, or 99% identical to the amino acid sequence of SEQ ID NO:62;

(3) a F2 polypeptide comprising the amino acid sequence of SEQ ID NO:63 and a F1 polypeptide comprising the amino acid sequence of SEQ ID NO:64;

(4) a F2 polypeptide comprising an amino acid sequence that is at least 97%, 98%, or 99% identical to the amino acid sequence of SEQ ID NO:63 and a F1 polypeptide comprising an amino acid sequence that is at least 97%, 98%, or 99% identical to the amino acid sequence of SEQ ID NO:64;

(5) a F2 polypeptide comprising the amino acid sequence of SEQ ID NO:65 and a F1 polypeptide comprising the amino acid sequence of SEQ ID NO:66;

(6) a F2 polypeptide comprising an amino acid sequence that is at least 97%, 98%, or 99% identical to the amino acid sequence of SEQ ID NO:65 and a F1 polypeptide comprising an amino acid sequence that is at least 97%, 98%, or 99% identical to the amino acid sequence of SEQ ID NO:66;

(7) a F2 polypeptide comprising the amino acid sequence of SEQ ID NO:67 and a F1 polypeptide comprising the amino acid sequence of SEQ ID NO:68;

(8) a F2 polypeptide comprising an amino acid sequence that is at least 97%, 98%, or 99% identical to the amino acid sequence of SEQ ID NO:67 and a F1 polypeptide comprising an amino acid sequence that is at least 97%, 98%, or 99% identical to the amino acid sequence of SEQ ID NO:68;

(9) a F2 polypeptide comprising the amino acid sequence of SEQ ID NO:69 and a F1 polypeptide comprising the amino acid sequence of SEQ ID NO:70;

(10) a F2 polypeptide comprising an amino acid sequence that is at least 97%, 98%, or 99% identical to the amino acid sequence of SEQ ID NO:69 and a F1 polypeptide comprising an amino acid sequence that is at least 97%, 98%, or 99% identical to the amino acid sequence of SEQ ID NO:70;

(11) a F2 polypeptide comprising the amino acid sequence of SEQ ID NO:303 and a F1 polypeptide comprising the amino acid sequence of SEQ ID NO:304;

(12) a F2 polypeptide comprising an amino acid sequence that is at least 97%, 98% or 99% identical to the amino acid sequence of SEQ ID NO:303 and a F1 polypeptide comprising an amino acid sequence that is at least 97%, 98%, or 99% identical to the amino acid sequence of SEQ ID NO:304;

(13) a F2 polypeptide comprising the amino acid sequence of SEQ ID NO:305 and a F1 polypeptide comprising the amino acid sequence of SEQ ID NO:306;

(14) a F2 polypeptide comprising an amino acid sequence that is at least 97%, 98%, or 99% identical to the amino acid sequence of SEQ ID NO:305 and a F1 polypeptide comprising an amino acid sequence that is at least 97%, 98%, or 99% identical to the amino acid sequence of SEQ ID NO:306;

(15) a F2 polypeptide comprising the amino acid sequence of SEQ ID NO:307 and a F1 polypeptide comprising the amino acid sequence of SEQ ID NO:308;

(16) a F2 polypeptide comprising an amino acid sequence that is at least 97%, 98%, or 99% identical to the amino acid sequence of SEQ ID NO:307 and a F1 polypeptide comprising an amino acid sequence that is at least 97%, 98%, or 99% identical to the amino acid sequence of SEQ ID NO:308;

(17) a F2 polypeptide comprising the amino acid sequence of SEQ ID NO:309 and a F1 polypeptide comprising the amino acid sequence of SEQ ID NO:310;

(18) a F2 polypeptide comprising an amino acid sequence that is at least 97%, 98%, or 99% identical to the amino acid sequence of SEQ ID NO:309 and a F1 polypeptide comprising an amino acid sequence that is at least 97%, 98%, or 99% identical to the amino acid sequence of SEQ ID NO:310;

(19) a F2 polypeptide comprising the amino acid sequence of SEQ ID NO:311 and a F1 polypeptide comprising the amino acid sequence of SEQ ID NO:312;

(20) a F2 polypeptide comprising an amino acid sequence that is at least 97%, 98%, or 99% identical to the amino acid sequence of SEQ ID NO:311 and a F1 polypeptide comprising an amino acid sequence that is at least 97%, 98%, or 99% identical to the amino acid sequence of SEQ ID NO:312.

(21) a F2 polypeptide comprising the amino acid sequence of SEQ ID NO:313 and a F1 polypeptide comprising the amino acid sequence of SEQ ID NO:314; and

(22) a F2 polypeptide comprising an amino acid sequence that is at least 97%, 98%, or 99% identical to the amino acid sequence of SEQ ID NO:313 and a F1 polypeptide comprising an amino acid sequence that is at least 97%, 98%, or 99% identical to the amino acid sequence of SEQ ID NO:314.

In some other particular embodiments, the nucleic acid molecule encodes a RSV F mutant, wherein the mutant comprises a histidine (H) at position 54, a cysteine (C) at positions 55 and 188, an isoleucine (I) at position 190 (190I), and a serine (S) at position 486, and wherein the mutant comprises a F1 polypeptide and a F2 polypeptide selected from the group consisting of:

(1) a F2 polypeptide comprising the amino acid sequence of SEQ ID NO:71 and a F1 polypeptide comprising the amino acid sequence of SEQ ID NO:72;

(2) a F2 polypeptide comprising an amino acid sequence that is at least 97%, 98%, or 99% identical to the amino acid sequence of SEQ ID NO:71 and a F1 polypeptide comprising an amino acid sequence that is at least 97%, 98%, or 99% identical to the amino acid sequence of SEQ ID NO:72;

(3) a F2 polypeptide comprising the amino acid sequence of SEQ ID NO:73 and a F1 polypeptide comprising the amino acid sequence of SEQ ID NO:74;

(4) a F2 polypeptide comprising an amino acid sequence that is at least 97%, 98%, or 99% identical to the amino acid sequence of SEQ ID NO:73 and a F1 polypeptide comprising an amino acid sequence that is at least 97%, 98%, or 99% identical to the amino acid sequence of SEQ ID NO:74;

(5) a F2 polypeptide comprising the amino acid sequence of SEQ ID NO:75 and a F1 polypeptide comprising the amino acid sequence of SEQ ID NO:76;

(6) a F2 polypeptide comprising an amino acid sequence that is at least 97%, 98%, or 99% identical to the amino acid sequence of SEQ ID NO:75 and a F1 polypeptide comprising an amino acid sequence that is at least 97%, 98%, or 99% identical to the amino acid sequence of SEQ ID NO:76;

(7) a F2 polypeptide comprising the amino acid sequence of SEQ ID NO:77 and a F1 polypeptide comprising the amino acid sequence of SEQ ID NO:78;

(8) a F2 polypeptide comprising an amino acid sequence that is at least 97%, 98%, or 99% identical to the amino acid sequence of SEQ ID NO:77 and a F1 polypeptide comprising an amino acid sequence that is at least 97%, 98%, or 99% identical to the amino acid sequence of SEQ ID NO:78;

(9) a F2 polypeptide comprising the amino acid sequence of SEQ ID NO:79 and a F1 polypeptide comprising the amino acid sequence of SEQ ID NO:80;

(10) a F2 polypeptide comprising an amino acid sequence that is at least 97%, 98%, or 99% identical to the amino acid sequence of SEQ ID NO:79 and a F1 polypeptide comprising an amino acid sequence that is at least 97%, 98%, or 99% identical to the amino acid sequence of SEQ ID NO:80;

(11) a F2 polypeptide comprising the amino acid sequence of SEQ ID NO:315 and a F1 polypeptide comprising the amino acid sequence of SEQ ID NO:316;

(12) a F2 polypeptide comprising an amino acid sequence that is at least 97%, 98%, or 99% identical to the amino acid sequence of SEQ ID NO:315 and a F1 polypeptide comprising an amino acid sequence that is at least 97%, 98%, or 99% identical to the amino acid sequence of SEQ ID NO:316;

(13) a F2 polypeptide comprising the amino acid sequence of SEQ ID NO:317 and a F1 polypeptide comprising the amino acid sequence of SEQ ID NO:318;

(14) a F2 polypeptide comprising an amino acid sequence that is at least 97%, 98%, or 99% identical to the amino acid sequence of SEQ ID NO:317 and a F1 polypeptide comprising an amino acid sequence that is at least 97%, 98%, or 99% identical to the amino acid sequence of SEQ ID NO:318;

(15) a F2 polypeptide comprising the amino acid sequence of SEQ ID NO:319 and a F1 polypeptide comprising the amino acid sequence of SEQ ID NO:320;

(16) a F2 polypeptide comprising an amino acid sequence that is at least 97%, 98%, or 99% identical to the amino acid sequence of SEQ ID NO:319 and a F1 polypeptide comprising an amino acid sequence that is at least 97%, 98%, or 99% identical to the amino acid sequence of SEQ ID NO:320;

(17) a F2 polypeptide comprising the amino acid sequence of SEQ ID NO:321 and a F1 polypeptide comprising the amino acid sequence of SEQ ID NO:322;

(18) a F2 polypeptide comprising an amino acid sequence that is at least 97%, 98%, or 99% identical to the amino acid sequence of SEQ ID NO:321 and a F1 polypeptide comprising an amino acid sequence that is at least 97%, 98%, or 99% identical to the amino acid sequence of SEQ ID NO:322;

(19) a F2 polypeptide comprising the amino acid sequence of SEQ ID NO:323 and a F1 polypeptide comprising the amino acid sequence of SEQ ID NO:324;

(20) a F2 polypeptide comprising an amino acid sequence that is at least 97%, 98%, or 99% identical to the amino acid sequence of SEQ ID NO:323 and a F1 polypeptide comprising an amino acid sequence that is at least 97%, 98%, or 99% identical to the amino acid sequence of SEQ ID NO:324.

(21) a F2 polypeptide comprising the amino acid sequence of SEQ ID NO:325 and a F1 polypeptide comprising the amino acid sequence of SEQ ID NO:326; and

(22) a F2 polypeptide comprising an amino acid sequence that is at least 97%, 98%, or 99% identical to the amino acid sequence of SEQ ID NO:325 and a F1 polypeptide comprising an amino acid sequence that is at least 97%, 98%, or 99% identical to the amino acid sequence of SEQ ID NO:326.

In some specific embodiments, the present disclosure provides a nucleic acid molecule, which encodes a mutant selected from the group consisting of:
(1) a mutant comprising amino acids 26-513 of SEQ ID NO:19;
(2) a mutant comprising amino acids 26-513 of SEQ ID NO:20; and
(3) a mutant comprising amino acids 26-513 of SEQ ID NO:21.

In some other specific embodiments, the present disclosure provides a nucleic acid molecule encoding a RSV F protein mutant, or a degenerate variant thereof, wherein the nucleic acid molecule comprises a nucleotide sequence selected from the group consisting of:
(1) a nucleotide sequence comprising nucleotides 76-1539 of SEQ ID NO:8;
(2) a nucleotide sequence comprising nucleotides 76-1539 of SEQ ID NO:9;
(3) a nucleotide sequence comprising nucleotides 76-1539 of SEQ ID NO:10;
(4) a nucleotide sequence comprising nucleotides 76-1539 of SEQ ID NO:11;
(5) a nucleotide sequence comprising nucleotides 76-1539 of SEQ ID NO:12;
(6) a nucleotide sequence comprising nucleotides 76-1539 of SEQ ID NO:13;
(7) a nucleotide sequence comprising nucleotides 76-1539 of SEQ ID NO:14;
(8) a nucleotide sequence comprising nucleotides 76-1539 of SEQ ID NO:15;
(9) a nucleotide sequence comprising nucleotides 76-1539 of SEQ ID NO:16;
(10) a nucleotide sequence comprising nucleotides 76-1539 of SEQ ID NO:17; and
(11) a nucleotide sequence comprising nucleotides 76-1539 of SEQ ID NO:18.

D. COMPOSITIONS COMPRISING A RSV F PROTEIN MUTANT; COMPOSITIONS COMPRISING A NUCLEIC ACID ENCODING A RSV F PROTEIN MUTANT

In another aspect, the invention provides compositions that comprise (1) a RSV F protein mutant described in the disclosure, or (2) a nucleic acid molecule or vector encoding such a RSV F protein mutant.

In some embodiments, the composition is an immunogenic composition capable of eliciting an immune response against the F protein of RSV in a subject. In some particular embodiments, the immunogenic composition is a pharmaceutical composition, which comprises a RSV F protein mutant provided by the present disclosure and a pharmaceutically acceptable carrier.

In still other embodiments, the pharmaceutical composition is a vaccine. The immunogenic component in the vaccine may be (1) a RSV F protein mutant described herein, (2) a nucleic acid encoding such as a RSV F protein mutant, or (3) a vector for expressing such a RSV F protein mutant.

In some particular embodiments, the vaccine comprises a RSV F protein mutant, wherein the mutant comprises a cysteine (C) at position 103 (103C) and at position 148 (148C), an isoleucine (I) at position 190 (190I), and a serine (S) at position 486 (486S), and wherein the mutant comprises a F1 polypeptide and a F2 polypeptide selected from the group consisting of:
(1) a F2 polypeptide comprising the amino acid sequence of SEQ ID NO:41 and a F1 polypeptide comprising the amino acid sequence of SEQ ID NO:42;
(2) a F2 polypeptide comprising an amino acid sequence that is at least 97%, 98%, or 99% identical to the amino acid sequence of SEQ ID NO:41 and a F1 polypeptide comprising an amino acid sequence that is at least 97%, 98%, or 99% identical to the amino acid sequence of SEQ ID NO:42;
(3) a F2 polypeptide comprising the amino acid sequence of SEQ ID NO: 43 and a F1 polypeptide comprising the amino acid sequence of SEQ ID NO:44;
(4) a F2 polypeptide comprising an amino acid sequence that is at least 97%, 98%, or 99% identical to the amino acid sequence of SEQ ID NO:43 and a F1 polypeptide comprising an amino acid sequence that is at least 97%, 98%, or 99% identical to the amino acid sequence of SEQ ID NO:44;
(5) a F2 polypeptide comprising the amino acid sequence of SEQ ID NO: 45 and a F1 polypeptide comprising the amino acid sequence of SEQ ID NO:46;
(6) a F2 polypeptide comprising an amino acid sequence that is at least 97%, 98%, or 99% identical to the amino acid sequence of SEQ ID NO:45 and a F1 polypeptide comprising an amino acid sequence that is at least 97%, 98%, or 99% identical to the amino acid sequence of SEQ ID NO:46;
(7) a F2 polypeptide comprising the amino acid sequence of SEQ ID NO: 47 and a F1 polypeptide comprising the amino acid sequence of SEQ ID NO:48;
(8) a F2 polypeptide comprising an amino acid sequence that is at least 97%, 98%, or 99% identical to the amino acid sequence of SEQ ID NO:47 and a F1 polypeptide comprising an amino acid sequence that is at least 97%, 98%, or 99% identical to the amino acid sequence of SEQ ID NO:48;
(9) a F2 polypeptide comprising the amino acid sequence of SEQ ID NO: 49 and a F1 polypeptide comprising the amino acid sequence of SEQ ID NO:50;
(10) a F2 polypeptide comprising an amino acid sequence that is at least 97%, 98%, or 99% identical to the amino acid sequence of SEQ ID NO:49 and a F1 polypeptide comprising an amino acid sequence that is at least 97%, 98%, or 99% identical to the amino acid sequence of SEQ ID NO:50.
(11) a F2 polypeptide comprising the amino acid sequence of SEQ ID NO:279 and a F1 polypeptide comprising the amino acid sequence of SEQ ID NO:280;
(12) a F2 polypeptide comprising an amino acid sequence that is at least 97%, 98%, or 99% identical to the amino acid sequence of SEQ ID NO:279 and a F1 polypeptide comprising an amino acid sequence that is at least 97%, 98%, or 99% identical to the amino acid sequence of SEQ ID NO:280;
(13) a F2 polypeptide comprising the amino acid sequence of SEQ ID NO:281 and a F1 polypeptide comprising the amino acid sequence of SEQ ID NO:282;
(14) a F2 polypeptide comprising an amino acid sequence that is at least 97%, 98%, or 99% identical to the amino acid sequence of SEQ ID NO:281 and a F1 polypeptide comprising an amino acid sequence that is at least 97%, 98%, or 99% identical to the amino acid sequence of SEQ ID NO:282;
(15) a F2 polypeptide comprising the amino acid sequence of SEQ ID NO:283 and a F1 polypeptide comprising the amino acid sequence of SEQ ID NO:284;
(16) a F2 polypeptide comprising an amino acid sequence that is at least 97%, 98%, or 99% identical to the amino acid sequence of SEQ ID NO:283 and a F1 polypeptide comprising an amino acid sequence that is at least 97%, 98%, or 99% identical to the amino acid sequence of SEQ ID NO:284;

(17) a F2 polypeptide comprising the amino acid sequence of SEQ ID NO:285 and a F1 polypeptide comprising the amino acid sequence of SEQ ID NO:286;

(18) a F2 polypeptide comprising an amino acid sequence that is at least 97%, 98%, or 99% identical to the amino acid sequence of SEQ ID NO:285 and a F1 polypeptide comprising an amino acid sequence that is at least 97%, 98%, or 99% identical to the amino acid sequence of SEQ ID NO:286;

(19) a F2 polypeptide comprising the amino acid sequence of SEQ ID NO:287 and a F1 polypeptide comprising the amino acid sequence of SEQ ID NO:288;

(20) a F2 polypeptide comprising an amino acid sequence that is at least 97%, 98%, or 99% identical to the amino acid sequence of SEQ ID NO:287 and a F1 polypeptide comprising an amino acid sequence that is at least 97%, 98%, or 99% identical to the amino acid sequence of SEQ ID NO:288;

(21) a F2 polypeptide comprising the amino acid sequence of SEQ ID NO:289 and a F1 polypeptide comprising the amino acid sequence of SEQ ID NO:290; and

(22) a F2 polypeptide comprising an amino acid sequence that is at least 97%, 98%, or 99% identical to the amino acid sequence of SEQ ID NO:289 and a F1 polypeptide comprising an amino acid sequence that is at least 97%, 98%, or 99% identical to the amino acid sequence of SEQ ID NO:290.

In some other particular embodiments, the vaccine comprises a RSV F mutant, wherein the mutant comprises a histidine (H) at position 54, a cysteine (C) at positions 103 and 148, a isoleucine (I) at positions 190 and 296, and a serine (S) at position 486, and wherein the mutant comprises a F1 polypeptide and a F2 polypeptide selected from the group consisting of:

(1) F2 polypeptide comprising the amino acid sequence of SEQ ID NO: 51 and a F1 polypeptide comprising the amino acid sequence of SEQ ID NO:52;

(2) a F2 polypeptide comprising an amino acid sequence that is at least 97%, 98%, or 99% identical to the amino acid sequence of SEQ ID NO:51 and a F1 polypeptide comprising an amino acid sequence that is at least 97%, 98%, or 99% identical to the amino acid sequence of SEQ ID NO:52;

(3) a F2 polypeptide comprising the amino acid sequence of SEQ ID NO:53 and a F1 polypeptide comprising the amino acid sequence of SEQ ID NO:54;

(4) a F2 polypeptide comprising an amino acid sequence that is at least 97%, 98%, or 99% identical to the amino acid sequence of SEQ ID NO:53 and a F1 polypeptide comprising an amino acid sequence that is at least 97%, 98%, or 99% identical to the amino acid sequence of SEQ ID NO:54;

(5) a F2 polypeptide comprising the amino acid sequence of SEQ ID NO:55 and a F1 polypeptide comprising the amino acid sequence of SEQ ID NO:56;

(6) a F2 polypeptide comprising an amino acid sequence that is at least 97%, 98%, or 99% identical to the amino acid sequence of SEQ ID NO:55 and a F1 polypeptide comprising an amino acid sequence that is at least 97%, 98%, or 99% identical to the amino acid sequence of SEQ ID NO:56;

(7) a F2 polypeptide comprising the amino acid sequence of SEQ ID NO:57 and a F1 polypeptide comprising the amino acid sequence of SEQ ID NO:58;

(8) a F2 polypeptide comprising an amino acid sequence that is at least 97%, 98%, or 99% identical to the amino acid sequence of SEQ ID NO:57 and a F1 polypeptide comprising an amino acid sequence that is at least 97%, 98%, or 99% identical to the amino acid sequence of SEQ ID NO:58;

(9) a F2 polypeptide comprising the amino acid sequence of SEQ ID NO:59 and a F1 polypeptide comprising the amino acid sequence of SEQ ID NO:60;

(10) a F2 polypeptide comprising an amino acid sequence that is at least 97%, 98%, or 99% identical to the amino acid sequence of SEQ ID NO:59 and a F1 polypeptide comprising an amino acid sequence that is at least 97%, 98%, or 99% identical to the amino acid sequence of SEQ ID NO:60;

(11) a F2 polypeptide comprising the amino acid sequence of SEQ ID NO:291 and a F1 polypeptide comprising the amino acid sequence of SEQ ID NO:292;

(12) a F2 polypeptide comprising an amino acid sequence that is at least 97%, 98%, or 99% identical to the amino acid sequence of SEQ ID NO:291 and a F1 polypeptide comprising an amino acid sequence that is at least 97%, 98%, or 99% identical to the amino acid sequence of SEQ ID NO:292;

(13) a F2 polypeptide comprising the amino acid sequence of SEQ ID NO:293 and a F1 polypeptide comprising the amino acid sequence of SEQ ID NO:294;

(14) a F2 polypeptide comprising an amino acid sequence that is at least 97%, 98%, or 99% identical to the amino acid sequence of SEQ ID NO:293 and a F1 polypeptide comprising an amino acid sequence that is at least 97%, 98%, or 99% identical to the amino acid sequence of SEQ ID NO:294;

(15) a F2 polypeptide comprising the amino acid sequence of SEQ ID NO:295 and a F1 polypeptide comprising the amino acid sequence of SEQ ID NO:296;

(16) a F2 polypeptide comprising an amino acid sequence that is at least 97%, 98%, or 99% identical to the amino acid sequence of SEQ ID NO:295 and a F1 polypeptide comprising an amino acid sequence that is at least 97%, 98%, or 99% identical to the amino acid sequence of SEQ ID NO:296;

(17) a F2 polypeptide comprising the amino acid sequence of SEQ ID NO:297 and a F1 polypeptide comprising the amino acid sequence of SEQ ID NO:298;

(18) a F2 polypeptide comprising an amino acid sequence that is at least 97%, 98%, or 99% identical to the amino acid sequence of SEQ ID NO:297 and a F1 polypeptide comprising an amino acid sequence that is at least 97%, 98%, or 99% identical to the amino acid sequence of SEQ ID NO:298;

(19) a F2 polypeptide comprising the amino acid sequence of SEQ ID NO:299 and a F1 polypeptide comprising the amino acid sequence of SEQ ID NO:300;

(20) a F2 polypeptide comprising an amino acid sequence that is at least 97%, 98%, or 99% identical to the amino acid sequence of SEQ ID NO:299 and a F1 polypeptide comprising an amino acid sequence that is at least 97%, 98%, or 99% identical to the amino acid sequence of SEQ ID NO:300;

(21) a F2 polypeptide comprising the amino acid sequence of SEQ ID NO:301 and a F1 polypeptide comprising the amino acid sequence of SEQ ID NO:302; and

(22) a F2 polypeptide comprising an amino acid sequence that is at least 97%, 98%, or 99% identical to the amino acid sequence of SEQ ID NO:301 and a F1 polypeptide comprising an amino acid sequence that is at least 97%, 98%, or 99% identical to the amino acid sequence of SEQ ID NO:302.

In some other particular embodiments, the vaccine comprises a RSV F mutant, wherein the mutant comprises a histidine (H) at position 54, a cysteine (C) at positions and 188, and a serine (S) at position 486, and wherein the mutant comprises a F1 polypeptide and a F2 polypeptide selected from the group consisting of:

(1) a F2 polypeptide comprising the amino acid sequence of SEQ ID NO:61 and a F1 polypeptide comprising the amino acid sequence of SEQ ID NO:62;

(2) a F2 polypeptide comprising an amino acid sequence that is at least 97%, 98%, or 99% identical to the amino acid sequence of SEQ ID NO:61 and a F1 polypeptide comprising an amino acid sequence that is at least 97%, 98%, or 99% identical to the amino acid sequence of SEQ ID NO:62;

(3) a F2 polypeptide comprising the amino acid sequence of SEQ ID NO:63 and a F1 polypeptide comprising the amino acid sequence of SEQ ID NO:64;

(4) a F2 polypeptide comprising an amino acid sequence that is at least 97%, 98%, or 99% identical to the amino acid sequence of SEQ ID NO:63 and a F1 polypeptide comprising an amino acid sequence that is at least 97%, 98%, or 99% identical to the amino acid sequence of SEQ ID NO:64;

(5) a F2 polypeptide comprising the amino acid sequence of SEQ ID NO:65 and a F1 polypeptide comprising the amino acid sequence of SEQ ID NO:66;

(6) a F2 polypeptide comprising an amino acid sequence that is at least 97%, 98%, or 99% identical to the amino acid sequence of SEQ ID NO:65 and a F1 polypeptide comprising an amino acid sequence that is at least 97%, 98%, or 99% identical to the amino acid sequence of SEQ ID NO:66;

(7) a F2 polypeptide comprising the amino acid sequence of SEQ ID NO:67 and a F1 polypeptide comprising the amino acid sequence of SEQ ID NO:68;

(8) a F2 polypeptide comprising an amino acid sequence that is at least 97%, 98%, or 99% identical to the amino acid sequence of SEQ ID NO:67 and a F1 polypeptide comprising an amino acid sequence that is at least 97%, 98%, or 99% identical to the amino acid sequence of SEQ ID NO:68;

(9) a F2 polypeptide comprising the amino acid sequence of SEQ ID NO:69 and a F1 polypeptide comprising the amino acid sequence of SEQ ID NO:70;

(10) a F2 polypeptide comprising an amino acid sequence that is at least 97%, 98%, or 99% identical to the amino acid sequence of SEQ ID NO:69 and a F1 polypeptide comprising an amino acid sequence that is at least 97%, 98%, or 99% identical to the amino acid sequence of SEQ ID NO:70;

(11) a F2 polypeptide comprising the amino acid sequence of SEQ ID NO:303 and a F1 polypeptide comprising the amino acid sequence of SEQ ID NO:304;

(12) a F2 polypeptide comprising an amino acid sequence that is at least 97%, 98%, or 99% identical to the amino acid sequence of SEQ ID NO:303 and a F1 polypeptide comprising an amino acid sequence that is at least 97%, 98%, or 99% identical to the amino acid sequence of SEQ ID NO:304;

(13) a F2 polypeptide comprising the amino acid sequence of SEQ ID NO:305 and a F1 polypeptide comprising the amino acid sequence of SEQ ID NO:306;

(14) a F2 polypeptide comprising an amino acid sequence that is at least 97%, 98%, or 99% identical to the amino acid sequence of SEQ ID NO:305 and a F1 polypeptide comprising an amino acid sequence that is at least 97%, 98%, or 99% identical to the amino acid sequence of SEQ ID NO:306;

(15) a F2 polypeptide comprising the amino acid sequence of SEQ ID NO:307 and a F1 polypeptide comprising the amino acid sequence of SEQ ID NO:308;

(16) a F2 polypeptide comprising an amino acid sequence that is at least 97%, 98%, or 99% identical to the amino acid sequence of SEQ ID NO:307 and a F1 polypeptide comprising an amino acid sequence that is at least 97%, 98%, or 99% identical to the amino acid sequence of SEQ ID NO:308;

(17) a F2 polypeptide comprising the amino acid sequence of SEQ ID NO:309 and a F1 polypeptide comprising the amino acid sequence of SEQ ID NO:310;

(18) a F2 polypeptide comprising an amino acid sequence that is at least 97%, 98%, or 99% identical to the amino acid sequence of SEQ ID NO:309 and a F1 polypeptide comprising an amino acid sequence that is at least 97%, 98%, or 99% identical to the amino acid sequence of SEQ ID NO:310;

(19) a F2 polypeptide comprising the amino acid sequence of SEQ ID NO:311 and a F1 polypeptide comprising the amino acid sequence of SEQ ID NO:312;

(20) a F2 polypeptide comprising an amino acid sequence that is at least 97%, 98%, or 99% identical to the amino acid sequence of SEQ ID NO:311 and a F1 polypeptide comprising an amino acid sequence that is at least 97%, 98%, or 99% identical to the amino acid sequence of SEQ ID NO:312.

(21) a F2 polypeptide comprising the amino acid sequence of SEQ ID NO:313 and a F1 polypeptide comprising the amino acid sequence of SEQ ID NO:314; and

(22) a F2 polypeptide comprising an amino acid sequence that is at least 97%, 98%, or 99% identical to the amino acid sequence of SEQ ID NO:313 and a F1 polypeptide comprising an amino acid sequence that is at least 97%, 98%, or 99% identical to the amino acid sequence of SEQ ID NO:314.

In some other particular embodiments, the vaccine comprises a RSV F mutant, wherein the mutant comprises a histidine (H) at position 54, a cysteine (C) at positions 55 and 188, an isoleucine (I) at position 190 (190I), and a serine (S) at position 486, and wherein the mutant comprises a F1 polypeptide and a F2 polypeptide selected from the group consisting of:

(1) a F2 polypeptide comprising the amino acid sequence of SEQ ID NO:71 and a F1 polypeptide comprising the amino acid sequence of SEQ ID NO:72;

(2) a F2 polypeptide comprising an amino acid sequence that is at least 97%, 98%, or 99% identical to the amino acid sequence of SEQ ID NO:71 and a F1 polypeptide comprising an amino acid sequence that is at least 97%, 98%, or 99% identical to the amino acid sequence of SEQ ID NO:72;

(3) a F2 polypeptide comprising the amino acid sequence of SEQ ID NO:73 and a F1 polypeptide comprising the amino acid sequence of SEQ ID NO:74;

(4) a F2 polypeptide comprising an amino acid sequence that is at least 97%, 98%, or 99% identical to the amino acid sequence of SEQ ID NO:73 and a F1 polypeptide comprising an amino acid sequence that is at least 97%, 98%, or 99% identical to the amino acid sequence of SEQ ID NO:74;

(5) a F2 polypeptide comprising the amino acid sequence of SEQ ID NO:75 and a F1 polypeptide comprising the amino acid sequence of SEQ ID NO:76;

(6) a F2 polypeptide comprising an amino acid sequence that is at least 97%, 98%, or 99% identical to the amino acid sequence of SEQ ID NO:75 and a F1 polypeptide comprising an amino acid sequence that is at least 97%, 98%, or 99% identical to the amino acid sequence of SEQ ID NO:76;

(7) a F2 polypeptide comprising the amino acid sequence of SEQ ID NO:77 and a F1 polypeptide comprising the amino acid sequence of SEQ ID NO:78;

(8) a F2 polypeptide comprising an amino acid sequence that is at least 97%, 98%, or 99% identical to the amino acid sequence of SEQ ID NO:77 and a F1 polypeptide comprising an amino acid sequence that is at least 97%, 98%, or 99% identical to the amino acid sequence of SEQ ID NO:78;

(9) a F2 polypeptide comprising the amino acid sequence of SEQ ID NO:79 and a F1 polypeptide comprising the amino acid sequence of SEQ ID NO:80;

(10) a F2 polypeptide comprising an amino acid sequence that is at least 97%, 98% or 99% identical to the amino acid sequence of SEQ ID NO:79 and a F1 polypeptide comprising an amino acid sequence that is at least 97%, 98%, or 99% identical to the amino acid sequence of SEQ ID NO:80;

(11) a F2 polypeptide comprising the amino acid sequence of SEQ ID NO:315 and a F1 polypeptide comprising the amino acid sequence of SEQ ID NO:316;

(12) a F2 polypeptide comprising an amino acid sequence that is at least 97%, 98%, or 99% identical to the amino acid sequence of SEQ ID NO:315 and a F1 polypeptide comprising an amino acid sequence that is at least 97%, 98%, or 99% identical to the amino acid sequence of SEQ ID NO:316;

(13) a F2 polypeptide comprising the amino acid sequence of SEQ ID NO:317 and a F1 polypeptide comprising the amino acid sequence of SEQ ID NO:318;

(14) a F2 polypeptide comprising an amino acid sequence that is at least 97%, 98%, or 99% identical to the amino acid sequence of SEQ ID NO:317 and a F1 polypeptide comprising an amino acid sequence that is at least 97%, 98%, or 99% identical to the amino acid sequence of SEQ ID NO:318;

(15) a F2 polypeptide comprising the amino acid sequence of SEQ ID NO:319 and a F1 polypeptide comprising the amino acid sequence of SEQ ID NO:320;

(16) a F2 polypeptide comprising an amino acid sequence that is at least 97%, 98%, or 99% identical to the amino acid sequence of SEQ ID NO:319 and a F1 polypeptide comprising an amino acid sequence that is at least 97%, 98%, or 99% identical to the amino acid sequence of SEQ ID NO:320;

(17) a F2 polypeptide comprising the amino acid sequence of SEQ ID NO:321 and a F1 polypeptide comprising the amino acid sequence of SEQ ID NO:322;

(18) a F2 polypeptide comprising an amino acid sequence that is at least 97%, 98%, or 99% identical to the amino acid sequence of SEQ ID NO:321 and a F1 polypeptide comprising an amino acid sequence that is at least 97%, 98%, or 99% identical to the amino acid sequence of SEQ ID NO:322;

(19) a F2 polypeptide comprising the amino acid sequence of SEQ ID NO:323 and a F1 polypeptide comprising the amino acid sequence of SEQ ID NO:324;

(20) a F2 polypeptide comprising an amino acid sequence that is at least 97%, 98%, or 99% identical to the amino acid sequence of SEQ ID NO:323 and a F1 polypeptide comprising an amino acid sequence that is at least 97%, 98%, or 99% identical to the amino acid sequence of SEQ ID NO:324.

(21) a F2 polypeptide comprising the amino acid sequence of SEQ ID NO:325 and a F1 polypeptide comprising the amino acid sequence of SEQ ID NO:326; and

(22) a F2 polypeptide comprising an amino acid sequence that is at least 97%, 98%, or 99% identical to the amino acid sequence of SEQ ID NO:325 and a F1 polypeptide comprising an amino acid sequence that is at least 97%, 98%, or 99% identical to the amino acid sequence of SEQ ID NO:326.

In some embodiments, a composition, such as a pharmaceutical composition or a vaccine, comprises two or more different RSV F mutants. The two or more different RSV F mutants may comprise the same introduced amino acid mutations but comprise a F1 polypeptide and F2 polypeptide from different RSV strains or subtypes. The two or more different RSV F mutants may comprise different introduced amino acid mutations.

In some embodiments, the composition comprises two different mutants comprising the same introduced amino acid mutations, wherein one of the mutant comprises a F1 polypeptide and F2 polypeptide from RSV subtype A and wherein the other mutant comprises a F1 polypeptide and F2 polypeptide from RSV subtype B. In some specific embodiments, the two different mutants comprise the same combination of amino acid substitutions selected from the group consisting of:

(1) a combination of amino acid substitutions 103C, 148C, 190I, and 486S;

(2) a combination of amino acid substitutions 54H, 55C, 188C, and 486S;

(3) a combination of amino acid substitutions 54H, 103C, 148C, 190I, 296I, and 486S;

(4) a combination of amino acid substitutions 54H, 55C, 142C, 188C, 296I, and 371C;

(5) a combination of amino acid substitutions 55C, 188C, and 486S;

(6) a combination of amino acid substitutions 54H, 55C, 188C, and 190I;

(7) a combination of amino acid substitutions 55C, 188C, 190I, and 486S;

(8) a combination of amino acid substitutions 54H, 55C, 188C, 190I, and 486S;

(9) a combination of amino acid substitutions 155C, 190I, 290C, and 486S;

(10) a combination of amino acid substitutions 54H, 55C, 142C, 188C, 296I, 371C, 486S, 487Q, and 489S; and

(11) a combination of amino acid substitutions 54H, 155C, 190I, 290C, and 296I.

In addition to the immunogenic component, the vaccine may further comprise an immunomodulatory agent, such as an adjuvant. Examples of suitable adjuvants include aluminum salts such as aluminum hydroxide and/or aluminum phosphate; oil-emulsion compositions (or oil-in-water compositions), including squalene-water emulsions, such as MF59 (see e.g., WO 90/14837); saponin formulations, such as, for example, QS21 and Immunostimulating Complexes (ISCOMS) (see e.g., U.S. Pat. No. 5,057,540; WO 90/03184, WO 96/11711, WO 2004/004762, WO 2005/002620); bacterial or microbial derivatives, examples of which are monophosphoryl lipid A (MPL), 3-O-deacylated MPL (3 dMPL), CpG-motif containing oligonucleotides, ADP-ribosylating bacterial toxins or mutants thereof, such as *E. coli* heat labile enterotoxin LT, cholera toxin CT, and the like. It is also possible to use vector-encoded adjuvant, e.g., by using heterologous nucleic acid that encodes a fusion of the oligomerization domain of C4-binding protein (C4 bp) to the antigen of interest (e.g., Solabomi et al., 2008, Infect Immun 76: 3817-23). In certain embodiments the compositions hereof comprise aluminum as an adjuvant, e.g., in the form of aluminum hydroxide, aluminum phosphate, aluminum potassium phosphate, or combinations thereof, in concentrations of 0.05-5 mg, e.g., from 0.075-1.0 mg, of aluminum content per dose.

E. USES OF THE RSV F PROTEIN MUTANTS, NUCLEIC ACID MOLECULES, AND COMPOSITIONS

The present disclosure also relates to use of a RSV F protein mutant, nucleic acids encoding a RSV F protein mutant, or vectors for expressing a RSV F protein mutant, or compositions comprising a RSV F protein mutant or nucleic acids.

In one aspect, the disclosure provides use of a RSV F protein mutant, nucleic acids encoding a RSV F protein mutant, or vectors for expressing a RSV F protein mutant, or compositions comprising a RSV F protein mutant or nucleic acids as a medicament, or in the manufacture of a medicament, for eliciting an immune response against RSV or for preventing or elevating RSV infection in a subject.

In other aspects, the present disclosure provides a method of eliciting an immune response against RSV in a subject, such as a human, comprising administering to the subject an effective amount of a RSV F protein mutant, a nucleic acid molecule encoding a RSV F protein mutant, or a composition comprising a RSV F protein mutant or nucleic acid molecule. The present disclosure also provides a method of preventing RSV infection in a subject, comprising administering to the subject an effective amount of a pharmaceutical composition, such as a vaccine, comprising a RSV F protein mutant, a nucleic acid encoding a RSV F protein mutant, or a vector expressing a RSV F protein mutant. In some particular embodiments, the pharmaceutical composition comprises a RSV F protein mutant. In some embodiments of the methods provided herein above, the subject is a human. In some particular embodiments, the human is a child, such as an infant. In some other particular embodiments, the human is a woman, particularly a pregnant woman.

The composition may be administered to the subject with or without administration of an adjuvant. The effective amount administered to the subject is an amount that is sufficient to elicit an immune response against an RSV antigen, such as RSV F protein, in the subject. Subjects that can be selected for treatment include those that are at risk for developing an RSV infection because of exposure or the possibility of exposure to RSV. Because nearly all humans are infected with RSV by the age of 2, the entire birth cohort is included as a relevant population for immunization. This could be done, for example, by beginning an immunization regimen anytime from birth to 6 months of age, from 6 months of age to 5 years of age, in pregnant women (or women of child-bearing age) to protect their infants by passive transfer of antibody, family members of newborn infants or those still in utero, and subjects greater than 50 years of age. Subjects at greatest risk of RSV infection with severe symptoms (e.g. requiring hospitalization) include children with prematurity, bronchopulmonary dysplasia, and congenital heart disease.

Administration of the compositions provided by the present disclosure, such as pharmaceutical compositions, can be carried out using standard routes of administration. Non-limiting embodiments include parenteral administration, such as intradermal, intramuscular, subcutaneous, transcutaneous, mucosal, or oral administration.

The total dose of the composition provided to a subject during one administration can be varied as is known to the skilled practitioner.

It is also possible to provide one or more booster administrations of one or more of the vaccine compositions. If a boosting vaccination is performed, typically, such a boosting vaccination will be administered to the same subject at a moment between one week and 10 years, preferably between two weeks and six months, after administering the composition to the subject for the first time (which is in such cases referred to as "priming vaccination"). In alternative boosting regimens, it is also possible to administer different vectors, e.g., one or more adenovirus, or other vectors such as modified vaccinia virus of Ankara (MVA), or DNA, or protein, to the subject after the priming vaccination. It is, for instance, possible to administer to the subject a recombinant viral vector hereof as a prime, and boosting with a composition comprising RSV F protein.

In certain embodiments, the administration comprises a priming administration and at least one booster administration. In certain other embodiments, the administration is provided annually. In still other embodiments, the administration is provided annually together with an influenza vaccine.

The vaccines provided by the present disclosure may be used together with one or more other vaccines. For example, in adults they may be used together with an influenza vaccine, Prevnar, tetanus vaccine, diphtheria vaccine, and pertussis vaccine. For pediatric use, vaccines provided by the present disclosure may be used with any other vaccine indicated for pediatric patients.

TABLE A

Non-consensus amino acid residues among F protein sequences from selected RSV A strains.

| | | | | Strain Name (GenBank) | | | | | |
|---|---|---|---|---|---|---|---|---|---|
| Amino Acid Position | A2 (138251) | RSVA/Homo sapiens/USA/L A2_21/2013 (AHX57185) | A/WI/629-4071/98 (AEQ63520) | TX-79223 (AGG39418) | BE08-5146 (AFM55563) | Tracy (AGG39397) | RSV-4 (AEO45850) | 06-000827 (AFM55442) | RSVA/Homo sapiens/USA/901-226A-01/1990 (AHY21463) |
| 4 | L | P | P | P | P | P | P | P | P |
| 6 | L | L | L | L | L | I | L | L | L |
| 8 | A | T | T | T | T | A | T | T | T |
| 15 | L | L | L | L | L | L | L | F | F |
| 16 | T | A | A | A | A | I | T | A | A |
| 20 | F | L | L | L | L | F | F | L | L |
| 25 | G | S | S | S | S | S | S | S | S |
| 59 | I | I | I | I | I | I | I | I | V |
| 101 | P | P | P | P | Q | T | P | P | P |
| 102 | P | A | A | A | A | A | A | A | A |
| 103 | T | A | A | A | A | A | A | A | A |
| 105 | N | S | N | N | S | N | N | N | N |
| 122 | A | T | T | T | T | A | T | T | T |
| 124 | K | N | N | T | N | K | N | N | N |
| 125 | T | T | T | T | T | T | N | N | T |
| 129 | L | L | V | L | L | L | L | L | L |

TABLE A-continued

Non-consensus amino acid residues among F protein sequences from selected RSV A strains.

| Amino Acid Position | A2 (138251) | RSVA/Homo sapiens/USA/L A2_21/2013 (AHX57185) | A/WI/629-4071/98 (AEQ63520) | TX-79223 (AGG39418) | BE08-5146 (AFM55563) | Tracy (AGG39397) | RSV-4 (AEO45850) | 06-000827 (AFM55442) | RSVA/Homo sapiens/USA/901-226A-01/1990 (AHY21463) |
|---|---|---|---|---|---|---|---|---|---|
| 152 | V | I | I | I | I | I | I | I | I |
| 276 | N | S | N | N | N | N | N | N | N |
| 356 | E | E | E | E | E | D | E | E | E |
| 379 | I | V | V | V | V | V | V | V | V |
| 384 | V | I | I | T | I | I | V | I | I |
| 447 | M | V | V | V | V | V | V | V | V |
| 518 | A | A | A | A | A | A | V | V | A |
| 540 | S | A | S | S | S | S | L | L | S |
| 547 | L | L | L | L | L | L | L | F | L |
| 562 | D | D | D | D | D | D | D | E | D |
| 574 | N | N | N | S | N | N | N | N | N |

TABLE B

Non-consensus amino acid residues among F protein sequences from selected RSV B strains.

| Amino Acid Position | 18537 (138250) | RSVB/Homo sapiens/PER/FPP00592/2011 (AHV80758) | NH1144 (AFD34260) | TX-79247 (AGG39514) | CH-18537 (AGG39487) | NH1125 (AFI25251) | TX-79222 (AGG39523) | TX-60567 (AGG39502) |
|---|---|---|---|---|---|---|---|---|
| 5 | I | I | I | I | I | I | I | V |
| 9 | S | S | S | S | S | S | I | S |
| 17 | V | I | I | I | V | I | I | I |
| 45 | F | F | F | L | F | F | F | F |
| 65 | K | K | K | K | K | K | T | K |
| 102 | A | A | A | V | A | A | A | A |
| 123 | K | K | K | K | K | K | K | N |
| 152 | I | I | I | I | M | I | I | I |
| 185 | V | V | V | V | I | V | V | V |
| 202 | R | Q | Q | Q | R | Q | Q | Q |
| 209 | Q | Q | K | Q | Q | Q | Q | Q |
| 226 | M | K | K | K | K | K | K | K |
| 234 | T | T | T | T | T | T | T | A |
| 292 | I | I | I | I | I | M | I | I |
| 326 | I | I | I | T | I | I | I | I |
| 371 | N | N | N | Y | N | N | N | N |
| 402 | I | I | V | I | I | I | I | I |
| 518 | T | T | T | T | T | T | V | T |
| 529 | T | A | A | A | T | V | A | A |

TABLE C

Variants of Mutant pXCS847 Comprising Introduced Mutations T103C, I148C, S190I, and D486S

| Mutant ID | F2 Polypeptide SEQ ID (residues 26-109) | Amino Acid Sequence | F1 Polypeptide SEQ ID (residues 137-513) | Amino Acid Sequence |
|---|---|---|---|---|
| pXCS847 | 41 | QNITEEFYQSTCSAVSK GYLSALRTGWYTSVITI ELSNIKENKCNGTDAK VKLIKQELDKYKNAVT ELQLLMQSTPACNNRA RR | 42 | FLGFLLGVGSACASGVAVSKVLHLEGEVNKIKSALLSTNKA VVSLSNGVSVLTSKVLDLKNYIDKQLLPIVNKQSCSISNIETV IEFQQKNNRLLEITREFSVNAGVTTPVSTYMLTNSELLSLIND MPITNDQKKLMSNNVQIVRQQSYSIMSIIKEEVLAYVVQLPL YGVIDTPCWKLHTSPLCTTNTKEGSNICLTRTDRGWYCDNA GSVSFFPQAETCKVQSNRVFCDTMNSLTLPSEVNLCNVDIFN PKYDCKIMTSKTDVSSSVITSLGAIVSCYGKTKCTASNKNRG IIKTFSNGCDYVSNKGVDTVSVGNTLYYVNKQEGKSLYVK GEPIINFYDPLVFPSIEFDASISQVNEKINQSLAFIRKSDELL |

TABLE C-continued

Variants of Mutant pXCS847 Comprising Introduced
Mutations T103C, I148C, S190I, and D486S

| Mutant ID | F2 Polypeptide SEQ ID | Amino Acid Sequence (residues 26-109) | F1 Polypeptide SEQ ID | Amino Acid Sequence (residues 137-513) |
|---|---|---|---|---|
| 847-138251 (A2) | 43 | QNITEEFYQSTCSAVSKGYLSAL TABLE C-continued Variants of Mutant pXCS847 Comprising Introduced
Mutations T103C, I148C, S190I, and D486S

| Mutant ID | F2 Polypeptide SEQ ID | Amino Acid Sequence (residues 26-109) | F1 Polypeptide SEQ ID | Amino Acid Sequence (residues 137-513) |
|---|---|---|---|---|
| 847-AFD34260 (B) | 285 | QNITEEFYQSTCSAVSR GYFSALRTGWYTSVITI ELSNIKETKCNGTDTKV KLIKQELDKYKNAVTE LQLLMQNTPACNNRARR | 286 | FLGFLLGVGSACASGIAVSKVLHLEGEVNKIKNALLSTNKA VVSLSNGVSVLTIKVLDLKNYINNQLLPIVNKQSCRISNIETV IEFQQKNSRLLEITREFSVNAGVTTPLSTYMLTNSELLSLIND MPITNDQKKLMSSNVQIVRQQSYSIMSIIKEEVLAYVVQLPI YGVIDTPCWKLHTSPLCTTNIKEGSNICLTRTDRGWYCDNA GSVSFFPQADTCKVQSNRVFCDTMNSLTLPSEVSLCNTDIFN SKYDCKIMTSKTDVSSSVITSLGAIVSCYGKTKCTASNKNRG IIKTFSNGCDYVSNKGVDTVSVGNTLYYVNKLEGKNLYVK GEPIINYYDPLVFPSSEFDASISQVNEKINQSLAFIRRSDELL |
| 847-BAE96918 (B) | 287 | QNITEEFYQSTCSAVSR GYFSALRTGWYTSVITI ELSNIKETKCNGTDTKV KLIKQELDKYKNAVTE LQLLMQNTPACNNRARR | 288 | FLGFLLGVGSACASGIAVSKVLHLEGEVNKIKNALLSTNKA VVSLSNGVSVLTIKVLDLKNYINNQLLPIVNKQSCRISNIETV IEFQQKNSRLLEITREFSVNAGVTTPLSTYMLTNSELLSLIND MPITNDQKKLMSSNVQIVRQQSYSIMSIMKEEVLAYVVQLPI YGVIDTPCWKLHTSPLCTTNIKEGSNICLTRTDRGWYCDNA GSVSFFPQADTCKVQSNRVFCDTMNSLTLPSEVSLCNTDIFN SKYDCKIMTSKTDISSSVITSLGAIVSCYGKTKCTASNKNRGI IKTFSNGCDYVSNKGVDTVSVGNTLYYVNKLEGKNLYVKG EPIINYYDPLVFPSSEFDASISQVNEKINQSLAFIRRSDELL |
| 847-AFD34265 (B) | 289 | QNITEEFYQSTCSAVSR GYLSALRTGWYTSVITI ELSNIKETKCNGTDTKV KLIKQELDKYKNAVTE LQLLMQNTPACNNRAR R | 290 | FLGFLLGVGSACASGIAVSKVLHLEGEVNKIKNALLSTNKA VVSLSNGVSVLTIKVLDLKNYINNQLLPIVNQQSCRISNIETV IEFQQKNSRLLEIAREFSVNAGVTTPLSTYMLTNSELLSLIND MPITNDQKKLMSSNVQIVRQQSYSIMSIIKEEVLAYVVQLPI YGVIDTPCWKLHTSPLCTTNIKEGSNICLTRTDRGWYCDNA GSVSFFPQADTCKVQSNRVFCDTMNSLTLPSEVSLCNTDIFN SKYDCKIMTSKTDISSSVITSLGAIVSCYGKTKCTASNKNRGI IKTFSNGCDYVSNKGVDTVSVGNTLYYVNKLEGKNLYVKG EPIINYYDPLVFPSSEFDASISQVNEKINQSLAFIRRSDELL |

TABLE D

Variant of Mutant pXCS851 Comprising Introduced Mutations
T54H, T103C, I148C, S190I, V296I, D486S

| Mutant ID | F2 Polypeptide SEQ ID | Amino Acid Sequence (residues 26-109) | F1 Polypeptide SEQ ID | Amino Acid Sequence (residues 137-513) |
|---|---|---|---|---|
| pXCS851 | 51 | QNITEEFYQSTCSAVSKG YLSALRTGWYHSVITIEL SNIKENKCNGTDAKVKLI KQELDKYKNAVTELQLL MQSTPACNNRARR | 52 | FLGFLLGVGSACASGVAVSKVLHLEGEVNKIKSALLST NKAVVSLSNGVSVLTIKVLDLKNYIDKQLLPIVNKQSC SISNIETVIEFQQKNRLLEITREFSVNAGVTTPVSTYML TNSELLSLINDMPITNDQKKLMSNNVQIVRQQSYSIMSI IKEEILAYVVQLPLYGVIDTPCWKLHTSPLCTTNTKEGS NICLTRTDRGWYCDNAGSVSFFPQAETCKVQSNRVFC DTMNSLTLPSEVNLCNVDIFNPKYDCKIMTSKTDVSSS VITSLGAIVSCYGKTKCTASNKNRGIIKTFSNGCDYVSN KGVDTVSVGNTLYYVNKQEGKSLYVKGEPIINFYDPL VFPSSEFDASISQVNEKINQSLAFIRKSDELL |
| GI-138251 (A2) | 53 | QNITEEFYQSTCSAVSKG YLSALRTGWYHSVITIEL SNIKENKCNGTDAKVKLI KQELDKYKNAVTELQLL MQSTPPCNNRARR | 54 | FLGFLLGVGSACASGVAVSKVLHLEGEVNKIKSALLST NKAVVSLSNGVSVLTIKVLDLKNYIDKQLLPIVNKQSC SISNIETVIEFQQKNNRLLEITREFSVNAGVTTPVSTYML TNSELLSLINDMPITNDQKKLMSNNVQIVRQQSYSIMSI IKEEILAYVVQLPLYGVIDTPCWKLHTSPLCTTNTKEGS NICLTRTDRGWYCDNAGSVSFFPQAETCKVQSNRVFC DTMNSLTLSEINLCNVDIFNPKYDCKIMTSKTDVSSSV ITSLGAIVSCYGKTKCTASNKNRGIIKTFSNGCDYVSNK GMDTVSVGNTLYYVNKQEGKSLYVKGEPIINFYDPLV FPSSEFDASISQVNEKINQSLAFIRKSDELL |
| GI-57185 (A) (Ontario) | 55 | QNITEEFYQSTCSAVSKG YLSALRTGWYHSVITIEL SNIKENKCNGTDAKVKLI KQELDKYKNAVTELQLL MQSTPACNSRARR | 56 | FLGFLLGVGSACASGIAVSKVLHLEGEVNKIKSALLST NKAVVSLSNGVSVLTIKVLDLKNYIDKQLLPIVNKQSC SISNIETVIEFQQKNNRLLEITREFSVNAGVTTPVSTYML TNSELLSLINDMPITNDQKKLMSSNVQIVRQQSYSIMSII KEEILAYVVQLPLYGVIDTPCWKLHTSPLCTTNTKEGS NICLTRTDRGWYCDNAGSVSFFPQAETCKVQSNRVFC |

TABLE D-continued

Variant of Mutant pXCS851 Comprising Introduced Mutations T54H, T103C, I148C, S190I, V296I, D486S

| | F2 Polypeptide | | F1 Polypeptide | |
|---|---|---|---|---|
| Mutant ID | SEQ ID | Amino Acid Sequence (residues 26-109) | SEQ ID | Amino Acid Sequence (residues 137-513) |
| | | | | DTMNSLTLPSEVNLCNIDIFNPKYDCKIMTSKTDVSSSV<br>ITSLGAIVSCYGKTKCTASNKNRGIIKTFSNGCDYVSNK<br>GVDTVSVGNTLYYVNKQEGKSLYVKGEPIINFYDPLVF<br>PSSEFDASISQVNEKINQSLAFIRKSDELL |
| GI-138250 (B) | 57 | QNITEEFYQSTCSAVSRG<br>YFSALRTGWYHSVITIEL<br>SNIKETKCNGTDTKVKLI<br>KQELDKYKNAVTELQLL<br>MQNTPACNNRARR | 58 | FLGFLLGVGSACASGIAVSKVLHLEGEVNKIKNALLST<br>NKAVVSLSNGVSVLTIKVLDLKNYINNRLLPIVNQQSC<br>RISNIETVIEFQQMNSRLLEITREFSVNAGVTTPLSTYML<br>TNSELLSLINDMPITNDQKKLMSSNVQIVRQQSYSIMSII<br>KEEILAYVVQLPIYGVIDTPCWKLHTSPLCTTNIKEGSN<br>ICLTRTDRGWYCDNAGSVSFFPQADTCKVQSNRVFCD<br>TMNSLTLPSEVSLCNTDIFNSKYDCKIMTSKTDISSSVIT<br>SLGAIVSCYGKTKCTASNKNRGIIKTFSNGCDYVSNKG<br>VDTVSVGNTLYYVNKLEGKNLYVKGEPIINYYDPLVFP<br>SSEFDASISQVNEKINQSLAFIRRSDELL |
| GI-80758 (B)<br>(Buenos Aires) | 59 | QNITEEFYQSTCSAVSRG<br>YFSALRTGWYHSVITIEL<br>SNIKETKCNGTDTKVKLI<br>KQELDKYKNAVTELQLL<br>MQNTPACNNRARR | 60 | FLGFLLGVGSACASGIAVSKVLHLEGEVNKIKNALLST<br>NKAVVSLSNGVSVLTIKVLDLKNYINNQLLPIVNQQSC<br>RISNIETVIEFQQKNSRLLEITREFSVNAGVTTPLSTYML<br>TNSELLSLINDMPITNDQKKLMSSNVQIVRQQSYSIMSII<br>KEEILAYVVQLPIYGVIDTPCWKLHTSPLCTTNIKEGSN<br>ICLTRTDRGWYCDNAGSVSFFPQADTCKVQSNRVFCD<br>TMNSLTLPSEVSLCNTDIFNSKYDCKIMTSKTDISSSVIT<br>SLGAIVSCYGKTKCTASNKNRGIIKTFSNGCDYVSNKG<br>VDTVSVGNTLYYVNKLEGKNLYVKGEPIINYYDPLVFP<br>SSEFDASISQVNEKINQSLAFIRRSDELL |
| 851-AFM55442<br>(A) | 291 | QNITEEFYQSTCSAVSKG<br>YLSALRTGWYHSVITIEL<br>SNIKENKCNGTDAKVKLI<br>KQELDKYKNAVTELQLL<br>MQSTPACNNRARR | 292 | FLGFLLGVGSACASGIAVSKVLHLEGEVNKIKSALLST<br>NKAVVSLSNGVSVLTIKVLDLKNYIDKQLLPIVNKQSC<br>SISNIETVIEFQQKNNRLLEITREFSVNAGVTTPVSTYML<br>TNSELLSLINDMPITNDQKKLMSNNVQIVRQQSYSIMSI<br>IKEEILAYVVQLPLYGVIDTPCWKLHTSPLCTTNTKEGS<br>NICLTRTDRGWYCDNAGSVSFFPQAETCKVQSNRVFC<br>DTMNSLTLPSEVNLCNIDIFNPKYDCKIMTSKTDVSSSV<br>ITSLGAIVSCYGKTKCTASNKNRGIIKTFSNGCDYVSNK<br>GVDTVSVGNTLYYVNKQEGKSLYVKGEPIINFYDPLVF<br>PSSEFDASISQVNEKINQSLAFIRKSDELL |
| 851-AFM95376<br>(A) | 293 | QNITEEFYQSTCSAVSKG<br>YLSALRTGWYHSVITIEL<br>SNIKENKCNGTDAKVKLI<br>KQELDKYKNAVTELQLL<br>MQSTPACNNRARR | 294 | FLGFLLGVGSACASGIAVSKVLHLEGEVNKIKSALLST<br>NKAVVSLSNGVSVLTIKVLDLKNYIDKQLLPIVNKQSC<br>SISNIETVIEFQQKNNRLLEITREFSVNAGVTTPVSTYML<br>TNSELLSLINDMPITNDQKKLMSNNVQIVRQQSYSIMSI<br>IKEEILAYVVQLPLYGVIDTPCWKLHTSPLCTTNTKEGS<br>NICLTRTDRGWYCDNAGSVSFFPQAETCKVQSNRVFC<br>DTMNSLTLPSEVNLCNIDIFNPKYDCKIMTSKTDVSSSV<br>ITSLGAIVSCYGKTKCTASNKNRGIIKTFSNGCDYVSNK<br>GVDTVSVGNTLYYVNKQEGKSLYVKGEPIINFYDPLVF<br>PSSEFDASISQVNEKINQSLAFIRKSDELL |
| 851-AEQ63520<br>(A) | 295 | QNITEEFYQSTCSAVSKG<br>YLSALRTGWYHSVITIEL<br>SNIKENKCNGTDAKVKLI<br>KQELDKYKNAVTELQLL<br>MQSTPACNNRARR | 296 | FLGFLLGVGSACASGIAVSKVLHLEGEVNKIKSALLST<br>NKAVVSLSNGVSVLTIKVLDLKNYIDKQLLPIVNKQSC<br>SISNIETVIEFQQKNNRLLEITREFSVNAGVTTPVSTYML<br>TNSELLSLINDMPITNDQKKLMSNNVQIVRQQSYSIMSI<br>IKEEILAYVVQLPLYGVIDTPCWKLHTSPLCTTNTKEGS<br>NICLTRTDRGWYCDNAGSVSFFPQAETCKVQSNRVFC<br>DTMNSLTLPSEVNLCNIDIFNPKYDCKIMTSKTDVSSSV<br>ITSLGAIVSCYGKTKCTASNKNRGIIKTFSNGCDYVSNK<br>GVDTVSVGNTLYYVNKQEGKSLYVKGEPIINFYDPLVF<br>PSSEFDASISQVNEKINQSLAFIRKSDELL |
| 851-AFD34260<br>(B) | 297 | QNITEEFYQSTCSAVSRG<br>YFSALRTGWYHSVITIEL<br>SNIKETKCNGTDTKVKLI<br>KQELDKYKNAVTELQLL<br>MQNTPACNNRARR | 298 | FLGFLLGVGSACASGIAVSKVLHLEGEVNKIKNALLST<br>NKAVVSLSNGVSVLTIKVLDLKNYINNQLLPIVNKQSC<br>RISNIETVIEFQQKNSRLLEITREFSVNAGVTTPLSTYML<br>TNSELLSLINDMPITNDQKKLMSSNVQIVRQQSYSIMSII<br>KEEILAYVVQLPIYGVIDTPCWKLHTSPLCTTNIKEGSN<br>ICLTRTDRGWYCDNAGSVSFFPQADTCKVQSNRVFCD<br>TMNSLTLPSEVSLCNTDIFNSKYDCKIMTSKTDVSSSVI<br>TSLGAIVSCYGKTKCTASNKNRGIIKTFSNGCDYVSNK<br>GVDTVSVGNTLYYVNKLEGKNLYVKGEPIINYYDPLV<br>FPSSEFDASISQVNEKINQSLAFIRRSDELL |

TABLE D-continued

Variant of Mutant pXCS851 Comprising Introduced Mutations
T54H, T103C, I148C, S190I, V296I, D486S

| Mutant ID | F2 Polypeptide Amino Acid Sequence SEQ ID (residues 26-109) | | F1 Polypeptide Amino Acid Sequence SEQ ID (residues 137-513) | |
|---|---|---|---|---|
| 851-BAE96918 (B) | 299 | QNITEEFYQSTCSAV TABLE E-continued Variant of Mutants pXCS852 Comprising Introduced Mutations T54H, S55C, L188C, D486S

| | F2 Polypeptide | | F1 Polypeptide | |
|---|---|---|---|---|
| Mutant ID | SEQ ID | Amino Acid Sequence (residues 26-109) | SEQ ID | Amino Acid Sequence (residues 137-513) |
| GI-138250 (B) | 67 | QNITEEFYQSTCSAVSRGY FSALRTGWYHCVITIELSN IKETKCNGTDTKVKLIKQE LDKYKNAVTELQLLMQN TPAANNRARR | 68 | FLGFLLGVGSAIASGIAVSKVLHLEGEVNKIKNALLST NKAVVSLSNGVSVCTSKVLDLKNYINNRLLPIVNQQS CRISNIETVIEFQQMNSLLEITREFSVNAGVTTPLSTY MLTNSELLSLINDMPITNDQKKLMSSNVQIVRQQSYS IMSIIKEEVLAYVVQLPIYGVIDTPCWKLHTSPLCTTNI KEGSNICLTRTDRGWYCDNAGSVSFFPQADTCKVQS NRVFCDTMNSLTLPSEVSLCNTDIFNSKYDCKIMTSK TDISSSVITSLGAIVSCYGKTKCTASNKNRGIIKTFSNG CDYVSNKGVDTVSVGNTLYYVNKLEGKNLYVKGEP IINYYDPLVFPSSEFDASISQVNEKINQSLAFIRRSDELL |
| GI-80758 (B) (Buenos Aires) | 69 | QNITEEFYQSTCSAVSRGY FSALRTGWYHCVITIELSN IKETKCNGTDTKVKLIKQE LDKYKNAVTELQLLMQN TPAANNRARR | 70 | FLGFLLGVGSAIASGIAVSKVLHLEGEVNKIKNALLST NKAVVSLSNGVSVCTSKVLDLKNYINNQLLPIVNQQ SCRISNIETVIEFQQKNSRLLEITREFSVNAGVTTPLST YMLTNSELLSLINDMPITNDQKKLMSSNVQIVRQQSY SIMSIIKEEVLAYVVQLPIYGVIDTPCWKLHTSPLCTT NIKEGSNICLTRTDRGWYCDNAGSVSFFPQADTCKV QSNRVFCDTMNSLTLPSEVSLCNTDIFNSKYDCKIMT SKTDISSSVITSLGAIVSCYGKTKCTASNKNRGIIKTFS NGCDYVSNKGVDTVSVGNTLYYVNKLEGKNLYVKG EPIINYYDPLVFPSSEFDASISQVNEKINQSLAFIRRSDE LL |
| 852-AFM55442 (A) | 303 | QNITEEFYQSTCSAVSKGY LSALRTGWYHCVITIELSN IKENKCNGTDAKVKLIKQ ELDKYKNAVTELQLLMQS TPAANNRARR | 304 | FLGFLLGVGSAIASGIAVSKVLHLEGEVNKIKSALLST NKAVVSLSNGVSVCTSKVLDLKNYIDKQLLPIVNKQ SCSISNIETVIEFQQKNNRLLEITREFSVNAGVTTPVST YMLTNSELLSLINDMPITNDQKKLMSNNVQIVRQQS YSIMSIIKEEVLAYVVQLPLYGVIDTPCWKLHTSPLCT TNTKEGSNICLTRTDRGWYCDNAGSVSFFPQAETCK VQSNRVFCDTMNSLTLPSEVNLCNIDIFNPKYDCKIM TSKTDVSSSVITSLGAIVSCYGKTKCTASNKNRGIIKT FSNGCDYVSNKGVDTVSVGNTLYYVNKQEGKSLYV KGEPIINFYDPLVFPSSEFDASISQVNEKINQSLAFIRKS DELL |
| 852-AFM95376 (A) | 305 | QNITEEFYQSTCSAVSKGY LSALRTGWYHCVITIELSN IKENKCNGTDAKVKLIKQ ELDKYKNAVTELQLLMQS TPAANNRARR | 306 | FLGFLLGVGSAIASGIAVSKVLHLEGEVNKIKSALLST NKAVVSLSNGVSVCTSKVLDLKNYIDKQLLPIVNKQ SCSISNIETVIEFQQKNNRLLEITREFSVNAGVTTPVST YMLTNSELLSLINDMPITNDQKKLMSNNVQIVRQQS YSIMSIIKEEVLAYVVQLPLYGVIDTPCWKLHTSPLCT TNTKEGSNICLTRTDRGWYCDNAGSVSFFPQAETCK VQSNRVFCDTMNSLTLPSEVNLCNIDIFNPKYDCKIM TSKTDVSSSVITSLGAIVSCYGKTKCTASNKNRGIIKT FSNGCDYVSNKGVDTVSVGNTLYYVNKQEGKSLYV KGEPIINFYDPLVFPSSEFDASISQVNEKINQSLAFIRKS DELL |
| 852-AEQ63520 (A) | 307 | QNITEEFYQSTCSAVSKGY LSALRTGWYHCVITIELSN IKENKCNGTDAKVKLIKQ ELDKYKNAVTELQLLMQS TPAANNRARR | 308 | FLGFLLGVGSAIASGIAVSKVLHLEGEVNKIKSALLST NKAVVSLSNGVSVCTSKVLDLKNYIDKQLLPIVNKQ SCSISNIETVIEFQQKNNRLLEITREFSVNAGVTTPVST YMLTNSELLSLINDMPITNDQKKLMSNNVQIVRQQS YSIMSIIKEEVLAYVVQLPLYGVIDTPCWKLHTSPLCT TNTKEGSNICLTRTDRGWYCDNAGSVSFFPQAETCK VQSNRVFCDTMNSLTLPSEVNLCNIDIFNPKYDCKIM TSKTDVSSSVITSLGAIVSCYGKTKCTASNKNRGIIKT FSNGCDYVSNKGVDTVSVGNTLYYVNKQEGKSLYV KGEPIINFYDPLVFPSSEFDASISQVNEKINQSLAFIRKS DELL |
| 852-AFD34260 (B) | 309 | QNITEEFYQSTCSAVSRGY FSALRTGWYHCVITIELSN IKETKCNGTDTKVKLIKQE LDKYKNAVTELQLLMQN TPAANNRARR | 310 | FLGFLLGVGSAIASGIAVSKVLHLEGEVNKIKNALLST NKAVVSLSNGVSVCTSKVLDLKNYINNQLLPIVNKQ SCRISNIETVIEFQQKNSRLLEITREFSVNAGVTTPLST YMLTNSELLSLINDMPITNDQKKLMSSNVQIVRQQSY SIMSIIKEEVLAYVVQLPIYGVIDTPCWKLHTSPLCTT NIKEGSNICLTRTDRGWYCDNAGSVSFFPQADTCKV QSNRVFCDTMNSLTLPSEVSLCNTDIFNSKYDCKIMT SKTDVSSSVITSLGAIVSCYGKTKCTASNKNRGIIKTF SNGCDYVSNKGVDTVSVGNTLYYVNKLEGKNLYVK GEPIINYYDPLVFPSSEFDASISQVNEKINQSLAFIRRS DELL |

TABLE E-continued

Variant of Mutants pXCS852 Comprising Introduced Mutations T54H, S55C, L188C, D486S

| Mutant ID | F2 Polypeptide SEQ ID | Amino Acid Sequence (residues 26-109) | F1 Polypeptide SEQ ID | Amino Acid Sequence (residues 137-513) |
|---|---|---|---|---|
| 852-BAE96918 (B) | 311 | QNITEEFYQSTCSAVSRGY FSALRTGWYHCVITIELSN IKETKCNGTDTKVKLIKQE LDKYKNAVTELQLLMQN TPAANNRARR | 312 | FLGFLLGVGSAIASGIAVSKVLHLEGEVNKIKNALLST NKAVVSLSNGVSVCTSKVLDLKNYINNQLLPIVNQQ SCRISNIETVIEFQQKNSRLLEITREFSVNAGVTTPLST YMLTNSELLSLINDMPITNDQKKLMSSNVQIVRQQSY SIMSIMKEEVLAYVVQLPIYGVIDTPCWKLHTSPLCTT NIKEGSNICLTRTDRGWYCDNAGSVSFFPQADTCKV QSNRVFCDTMNSLTLPSEVSLCNTDIFNSKYDCKIMT SKTDISSSVITSLGAIVSCYGKTKCTASNKNRGIIKTFS NGCDYVSNKGVDTVSVGNTLYYVNKLEGKNLYVKG EPIINYYDPLVFPSSEFDASISQVNEKINQSLAFIRRSDE LL |
| 852-AFD34265 (B) | 313 | QNITEEFYQSTCSAVSRGY LSALRTGWYHCVITIELSN IKETKCNGTDTKVKLIKQE LDKYKNAVTELQLLMQN TPAANNRARR | 314 | FLGFLLGVGSAIASGIAVSKVLHLEGEVNKIKNALLST NKAVVSLSNGVSVCTSKVLDLKNYINNQLLPIVNQQ SCRISNIETVIEFQQKNSRLLEIAREFSVNAGVTTPLST YMLTNSELLSLINDMPITNDQKKLMSSNVQIVRQQSY SIMSIIKEEVLAYVVQLPIYGVIDTPCWKLHTSPLCTT NIKEGSNICLTRTDRGWYCDNAGSVSFFPQADTCKV QSNRVFCDTMNSLTLPSEVSLCNTDIFNSKYDCKIMT SKTDISSSVITSLGAIVSCYGKTKCTASNKNRGIIKTFS NGCDYVSNKGVDTVSVGNTLYYVNKLEGKNLYVKG EPIINYYDPLVFPSSEFDASISQVNEKINQSLAFIRRSDE LL |

TABLE F

Variant of Mutant pXCS855 Comprising Introduced Mutations T54H, S55C, L188C, S190I, D486S

| Mutant ID | F2 Polypeptide SEQ ID | Amino Acid Sequence (residues 26-109) | F1 Polypeptide SEQ ID | Amino Acid Sequence (residues 137-513) |
|---|---|---|---|---|
| pXCS855 | 71 | QNITEEFYQSTCSAVSKGY LSALRTGWYHCVITIELSN IKENKCNGTDAKVKLIKQ ELDKYKNAVTELQLLMQS TPATNNRARR | 72 | FLGFLLGVGSAIASGVAVSKVLHLEGEVNKIKSALLST NKAVVSLSNGVSVCTIKVLDLKNYIDQLLPIVNKQSC SISNIETVIEFQQKNRLLEITREFSVNAGVTTPVSTYML TNSELLSLINDMPITNDQKKLMSNNVQIVRQQSYSIMSI IKEEVLAYVVQLPLYGVIDTPCWKLHTSPLCTTNTKEG SNICLTRTDRGWYCDNAGSVSFFPQAETCKVQSNRVF CDTMNSLTLPSEVNLCNVDIFNPKYDCKIMTSKTDVSS SVITSLGAIVSCYGKTKCTASNKNRGIIKTFSNGCDYVS NKGVDTVSVGNTLYYVNKQEGKSLYVKGEPIINFYDP LVFPSSEFDASISQVNEKINQSLAFIRKSDELL |
| 855-GI138251 (A2) | 73 | QNITEEFYQSTCSAVSKGY LSALRTGWYHCVITIELSN IKENKCNGTDAKVKLIKQ ELDKYKNAVTELQLLMQS TPPTNNRARR | 74 | FLGFLLGVGSAIASGVAVSKVLHLEGEVNKIKSALLST NKAVVSLSNGVSVCTIKVLDLKNYIDKQLLPIVNKQSC SISNIETVIEFQQKNRLLEITREFSVNAGVTTPVSTYML TNSELLSLINDMPITNDQKKLMSNNVQIVRQQSYSIMSI IKEEVLAYVVQLPLYGVIDTPCWKLHTSPLCTTNTKEG SNICLTRTDRGWYCDNAGSVSFFPQAETCKVQSNRVF CDTMNSLTLPSEINLCNVDIFNPKYDCKIMTSKTDVSSS VITSLGAIVSCYGKTKCTASNKNRGIIKTFSNGCDYVSN KGMDTVSVGNTLYYVNKQEGKSLYVKGEPIINFYDPL VFPSSEFDASISQVNEKINQSLAFIRKSDELL |
| 855-GI57185 (A) (Ontario) | 75 | QNITEEFYQSTCSAVSKGY LSALRTGWYHCVITIELSN IKENKCNGTDAKVKLIKQ ELDKYKNAVTELQLLMQS TPAANSRARR | 76 | FLGFLLGVGSAIASGIAVSKVLHLEGEVNKIKSALLSTN AVVSLSNGVSVCTIKVLDLKNYIDKQLLPIVNKQSCSI SNIETVIEFQQKNRLLEITREFSVNAGVTTPVSTYMLT NSELLSLINDMPITNDQKKLMSSNVQIVRQQSYSIMSII KEEVLAYVVQLPLYGVIDTPCWKLHTSPLCTTNTKEGS NICLTRTDRGWYCDNAGSVSFFPQAETCKVQSNRVFC DTMNSLTLPSEVNLCNIDIFNPKYDCKIMTSKTDVSSSV ITSLGAIVSCYGKTKCTASNKNRGIIKTFSNGCDYVSNK GVDTVSVGNTLYYVNKQEGKSLYVKGEPIINFYDPLVF PSSEFDASISQVNEKINQSLAFIRKSDELL |
| 855-0138250 (B) | 77 | QNITEEFYQSTCSAVSRGY FSALRTGWYHCVITIELSN | 78 | FLGFLLGVGSAIASGIAVSKVLHLEGEVNKIKNALLSTN KAVVSLSNGVSVCTIKVLDLKNYINNRLLPIVNQQSCR |

TABLE F-continued

Variant of Mutant pXCS855 Comprising Introduced Mutations
T54H, S55C, L188C, S190I, D486S

| Mutant ID | F2 Polypeptide Amino Acid Sequence SEQ ID (residues 26-109) | | F1 Polypeptide Amino Acid Sequence SEQ ID (residues 137-513) | |
|---|---|---|---|---|
| | | IKETKCNGTDTKVKLIKQE LDKYKNAVTELQLLMQN TPAANNRARR | | ISNIETVIEFQQMNSRLLEITREFSVNAGVTTPLSTYMLT NSELLSLINDMPITNDQKKLMSSNVQIVRQQSYSIMSII KEEVLAYVVQLPIYGVIDTPCWKLHTSPLCTTNIKEGS NICLTRTDRGWYCDNAGSVSFFPQADTCKVQSNRVFC DTMNSLTLPSEVSLCNTDIFNSKYDCKIMTSKTDISSSVI TSLGAIVSCYGKTKCTASNKNRGIIKTFSNGCDYVSNK GVDTVSVGNTLYYVNKLEGKNLYVKGEPIINYYDPLV FPSSEFDASISQVNEKINQSLAFIRRSDELL |
| 855-GI80758 (B) (Buenos Aires) | 79 | QNITEEFYQSTCSAVSRGY FSALRTGWYHCVITIELSN IKETKCNGTDTKVKLIKQE LDKYKNAVTELQLLMQN TPAANNRARR | 80 | FLGFLLGVGSAIASGIAVSKVLHLEGEVNKIKNALLSTN KAVVSLSNGVSVCTIKVLDLKNYINNQLLPIVNQQSCR ISNIETVIEFQQKNSRLLEITREFSVNAGVTTPLSTYMLT NSELLSLINDMPITNDQKKLMSSNVQIVRQQSYSIMSII KEEVLAYVVQLPIYGVIDTPCWKLHTSPLCTTNIKEGS NICLTRTDRGWYCDNAGSVSFFPQADTCKVQSNRVFC DTMNSLTLPSEVSLCNTDIFNSKYDCKIMTSKTDISSSVI TSLGAIVSCYGKTKCTASNKNRGIIKTFSNGCDYVSNK GVDTVSVGNTLYYVNKLEGKNLYVKGEPIINYYDPLV FPSSEFDASISQVNEKINQSLAFIRRSDELL |
| 855-AFM55442 (A) | 315 | QNITEEFYQSTCSAVSKGY LSALRTGWYHCVITIELSN IKENKCNGTDAKVKLIKQ ELDKYKNAVTELQLLMQS TPAANNRARR | 316 | FLGFLLGVGSAIASGIAVSKVLHLEGEVNKIKSALLSTN KAVVSLSNGVSVCTIKVLDLKNYIDKQLLPIVNKQSCSI SNIETVIEFQQKNNRLLEITREFSVNAGVTTPVSTYMLT NSELLSLINDMPITNDQKKLMSNNVQIVRQQSYSIMSII KEEVLAYVVQLPLYGVIDTPCWKLHTSPLCTTNTKEGS NICLTRTDRGWYCDNAGSVSFFPQAETCKVQSNRVFC DTMNSLTLPSEVNLCNIDIFNPKYDCKIMTSKTDVSSSV ITSLGAIVSCYGKTKCTASNKNRGIIKTFSNGCDYVSNK GVDTVSVGNTLYYVNKQEGKSLYVKGEPIINFYDPLVF PSSEFDASISQVNEKINQSLAFIRKSDELL |
| 855-AFM95376 (A) | 317 | QNITEEFYQSTCSAVSKGY LSALRTGWYHCVITIELSN IKENKCNGTDAKVKLIKQ ELDKYKNAVTELQLLMQS TPAANNRARR | 318 | FLGFLLGVGSAIASGIAVSKVLHLEGEVNKIKSALLSTN KAVVSLSNGVSVCTIKVLDLKNYIDKQLLPIVNKQSCSI SNIETVIEFQQKNNRLLEITREFSVNAGVTTPVSTYMLT NSELLSLINDMPITNDQKKLMSNNVQIVRQQSYSIMSII KEEVLAYVVQLPLYGVIDTPCWKLHTSPLCTTNTKEGS NICLTRTDRGWYCDNAGSVSFFPQAETCKVQSNRVFC DTMNSLTLPSEVNLCNIDIFNPKYDCKIMTSKTDVSSSV ITSLGAIVSCYGKTKCTASNKNRGIIKTFSNGCDYVSNK GVDTVSVGNTLYYVNKQEGKSLYVKGEPIINFYDPLVF PSSEFDASISQVNEKINQSLAFIRKSDELL |
| 855-AEQ63520 (A) | 319 | QNITEEFYQSTCSAVSKGY LSALRTGWYHCVITIELSN IKENKCNGTDAKVKLIKQ ELDKYKNAVTELQLLMQS TPAANNRARR | 320 | FLGFLLGVGSAIASGIAVSKVLHLEGEVNKIKSALLSTN KAVVSLSNGVSVCTIKVLDLKNYIDKQLLPIVNKQSCSI SNIETVIEFQQKNNRLLEITREFSVNAGVTTPVSTYMLT NSELLSLINDMPITNDQKKLMSNNVQIVRQQSYSIMSII KEEVLAYVVQLPLYGVIDTPCWKLHTSPLCTTNTKEGS NICLTRTDRGWYCDNAGSVSFFPQAETCKVQSNRVFC DTMNSLTLPSEVNLCNIDIFNPKYDCKIMTSKTDVSSSV ITSLGAIVSCYGKTKCTASNKNRGIIKTFSNGCDYVSNK GVDTVSVGNTLYYVNKQEGKSLYVKGEPIINFYDPLVF PSSEFDASISQVNEKINQSLAFIRKSDELL |
| 855-AFD34260 (B) | 321 | QNITEEFYQSTCSAVSRGY FSALRTGWYHCVITIELSN IKETKCNGTDTKVKLIKQE LDKYKNAVTELQLLMQN TPAANNRARR | 322 | FLGFLLGVGSAIASGIAVSKVLHLEGEVNKIKNALLSTN KAVVSLSNGVSVCTIKVLDLKNYINNQLLPIVNKQSCR ISNIETVIEFQQKNSRLLEITREFSVNAGVTTPLSTYMLT NSELLSLINDMPITNDQKKLMSSNVQIVRQQSYSIMSII KEEVLAYVVQLPIYGVIDTPCWKLHTSPLCTTNIKEGS NICLTRTDRGWYCDNAGSVSFFPQADTCKVQSNRVFC DTMNSLTLPSEVSLCNTDIFNSKYDCKIMTSKTDVSSSV ITSLGAIVSCYGKTKCTASNKNRGIIKTFSNGCDYVSNK GVDTVSVGNTLYYVNKLEGKNLYVKGEPIINYYDPLV FPSSEFDASISQVNEKINQSLAFIRRSDELL |
| 855-BAE96918 (B) | 323 | QNITEEFYQSTCSAVSRGY FSALRTGWYHCVITIELSN IKETKCNGTDTKVKLIKQE LDKYKNAVTELQLLMQN TPAANNRARR | 324 | FLGFLLGVGSAIASGIAVSKVLHLEGEVNKIKNALLSTN KAVVSLSNGVSVCTIKVLDLKNYINNQLLPIVNQQSCR ISNIETVIEFQQKNSRLLEITREFSVNAGVTTPLSTYMLT NSELLSLINDMPITNDQKKLMSSNVQIVRQQSYSIMSIM KEEVLAYVVQLPIYGVIDTPCWKLHTSPLCTTNIKEGS NICLTRTDRGWYCDNAGSVSFFPQADTCKVQSNRVFC DTMNSLTLPSEVSLCNTDIFNSKYDCKIMTSKTDISSSVI TSLGAIVSCYGKTKCTASNKNRGIIKTFSNGCDYVSNK |

TABLE F-continued

Variant of Mutant pXCS855 Comprising Introduced Mutations
T54H, S55C, L188C, S190I, D486S

| Mutant ID | F2 Polypeptide Amino Acid Sequence SEQ ID (residues 26-109) | F1 Polypeptide Amino Acid Sequence SEQ ID (residues 137-513) |
|---|---|---|
| 855-AFD34265 (B) | 325 QNITEEFYQSTCSAVSRGY LSALRTGWYHCVITIELSN IKETKCNGTDTKVKLIKQE LDKYKNAVTELQLLMQN TPAANNRARR | 326 FLGFLLGVGSAIASGIAVSKVLHLEGEVNKIKNALLSTN KAVVSLSNGVSVCTIKVLDLKNYINNQLLPIVNQQSCR ISNIETVIEFQQKNSRLLEIAREFSVNAGVTTPLSTYMLT NSELLSLINDMPITNDQKKLMSSNVQIVRQQSYSIMSII KEEVLAYVVQLPIYGVIDTPCWKLHTSPLCTTNIKEGS NICLTRTDRGWYCDNAGSVSFFPQADTCKVQSNRVFC DTMNSLTLPSEVSLCNTDIFNSKYDCKIMTSKTDISSSVI TSLGAIVSCYGKTKCTASNKNRGIIKTFSNGCDYVSNK GVDTVSVGNTLYYVNKLEGKNLYVKGEPIINYYDPLV FPSSEFDASISQVNEKINQSLAFIRRSDELL |

TABLE G

Sequence Index

| SEQ ID NO | Description |
|---|---|
| 1, 4, 81-210 | Amino acid sequence of F0 precursor polypeptide of representative RSV subtype A |
| 2, 6, 211-263 | Amino acid sequence of F0 precursor polypeptide of representative RSV subtype B |
| 264-270 | Amino acid sequence of F0 precursor polypeptide of representative bovine RSV |
| 3 | Amino acid sequence of the ectodomain (with foldon) of RSV A2, |
| 5 | Amino acid sequence of the ectodomain (with foldon) of RSV A (Ontario) |
| 7 | Amino acid sequence of the ectodomain (with foldon) of a RSV B strain |
| 8-18 | Nucleotide sequence encoding the precursor polypeptide of representative RSV F mutants |
| 19-21, 32-39, 271-278 | Amino acid sequence of F precursor polypeptide of representative RSV F mutants |
| 22-31 | Amino acid sequences of the light chain variable domain and heavy chain variable domain of RSV F antibodies |
| 40 | Amino acid sequence of T4 Fibritin foldon |
| 41-80, 279-326 | Amino acid sequence of F2 polypeptide and F1 polypeptide of representative RSV F mutants |

F. EXAMPLES

The invention is further described by the following illustrative examples. The examples do not limit the invention in any way. They merely serve to clarify the invention.

Example 1: Design and Preparation of RSV F Protein Mutants

1A: RSV F Mutants with Foldon Domain

This example illustrates the design and preparation of various RSV F protein mutants, which include a fibritin foldon trimerization domain and introduced amino acid mutations, such as engineered disulfide bond mutations, cavity-filling mutations, electrostatic mutations, or a combination thereof. Exemplary RSV F mutants, each of which is identified by an unique identifier, such as pXCS501, pXCS601, etc., are provided in Tables 1-6. Each of these mutants was designed and prepared based on the amino acid sequence set forth in SEQ ID NO:3, which is also illustrated in FIG. 1. Amino acid residues 1-513 of the sequence of SEQ ID NO:3 are identical to amino acid residues 1-513 of the F0 precursor polypeptide of native RSV A2 as set forth in SEQ ID NO:1, except for the three naturally occurring substitutions, P102A, I379V and M447V, in the sequence of SEQ ID NO:3. Therefore, the amino acid sequences of these exemplary F mutants are identical except for the introduced amino acid mutations as noted for each mutant listed in Tables 1-6. Each of these RSV F protein mutants comprises two separate polypeptide chains. One of the polypeptide chains, the F2 polypeptide, comprises amino acids 26-109 of SEQ ID NO:3 except for the introduced mutations as noted. The other polypeptide chain comprises the F1 polypeptide (residues 137-513) linked to a foldon trimerization domain (residues 518-544) via a SAIG linker (residues 514-517). The signal peptide (residues 1-25) and pep27 (residues 110-136) of SEQ ID NO:3 were cleaved from the F0 precursor during the expression process. The process for expression and purification of these exemplary RSV F mutants is described in Examples 2 and 3.

1B: RSV F Mutants without Foldon Domain

RSV F mutant, pXCS899, which was devoid of foldon domain, was prepared in the same method described in Example 1A above, except that amino acids 514-544 of the F0 precursor sequence of SEQ ID NO:3 were deleted. The amino acid sequence of the precursor polypeptide of pXCS899 is set forth in SEQ ID NO:271.

TABLE 1

Exemplary RSV F Protein Mutants Comprising
Engineered Disulfide Mutations

| Mutant ID | Mutations |
|---|---|
| pXCS501 | I28C, G464C |
| pXCS502 | E30C, S466C |
| pXCS503 | Q34C, G471C |
| pXCS504 | S35C, G471C |
| pXCS505 | W52C, S150C |
| pXCS506 | T54C, G151C |
| pXCS507 | S55C, L188C |
| pXCS508 | V56C, V187C |
| pXCS509 | V56C, T189C |
| pXCS510 | I57C, S190C |
| pXCS511 | T58C, K191C |
| pXCS512 | I59C, L193C |
| pXCS513 | E60C, K196C |
| pXCS514 | L61C, L195C |
| pXCS515 | S62C, K196C |

TABLE 1-continued

Exemplary RSV F Protein Mutants Comprising Engineered Disulfide Mutations

| Mutant ID | Mutations |
| --- | --- |
| pXCS516 | S62C, I199C |
| pXCS518 | T103C, A147C |
| pXCS519 | T103C, I148C |
| pXCS520 | R106C, V144C |
| pXCS521 | L138C, T337C |
| pXCS522 | G139C, P353C |
| pXCS523 | G139C, Q354C |
| pXCS524 | L142C, N371C |
| pXCS525 | G145C, M370C |
| pXCS526 | I148C, Y286C |
| pXCS527 | G151C, V300C |
| pXCS528 | G151C, Q302C |
| pXCS529 | V154C, V300C |
| pXCS531 | S155C, V300C |
| pXCS532 | L158C, S290C |
| pXCS534 | V164C, K293C |
| pXCS535 | V164C, E294C |
| pXCS536 | T397C, P484C |
| pXCS537 | T397C, E487C |
| pXCS538 | K399C, S485C |
| pXCS539 | L410C, G464C |
| pXCS540 | L410C, S466C |
| pXCS541 | S443C, S466C |
| pXCS542 | L138C, P353C |
| pXCS543 | G151C, I288C |
| pXCS544 | S155C, S290C |
| pXCS545 | S155C, S290C; I28C, G464C |
| pXCS546 | S155C, S290C; E30C, S466C |
| pXCS547 | S155C, S290C; Q34C, G471C |
| pXCS548 | S155C, S290C; S35C, G471C |
| pXCS549 | S155C, S290C; T397C, P484C |
| pXCS550 | S155C, S290C; T397C, E487C |
| pXCS551 | S155C, S290C; K399C, S485C |
| pXCS553 | S155C, S290C; L410C, S466C |
| pXCS554 | S155C, S290C; S443C, S466C |
| pXCS556 | R106C, V144C; S443C, S466C |
| pXCS557 | R106C, V144C; L142C, N371C |
| pXCS558 | R106C, V144C; T397C, P484C |
| pXCS596 | S55C, L188C; T103C, I148C |
| pXCS597 | S55C, L188C; R106C, V144C |
| pXCS598 | S55C, L188C; L142C, N371C |
| pXCS599 | S55C, L188C; T397C, P484C |
| pXCS600 | S55C, L188C; Q34C, G471C |
| pXCS601 | S55C, L188C; T397C, E487C |
| pXCS602 | S55C, L188C; S443C, S466C |
| pXCS603 | S55C, L188C; L410C, S466C |
| pXCS604 | S55C, L188C; S35C, G471C |
| pXCS605 | S55C, L188C; S62C, I199C |
| pXCS606 | T103C, I148C; Q34C, G471C |
| pXCS607 | T103C, I148C; S35C, G471C |
| pXCS608 | T103C, I148C; S62C, I199C |
| pXCS609 | T103C, I148C; L142C, N371C |
| pXCS610 | T103C, I148C; T397C, P484C |
| pXCS611 | T103C, I148C; T397C, E487C |
| pXCS612 | T103C, I148C; L410C, S466C |
| pXCS613 | T103C, I148C; S443C, S466C |
| pXCS614 | Q34C, G471C; S62C, I199C |
| pXCS615 | Q34C, G471C; R106C, V144C |
| pXCS616 | Q34C, G471C; L138C, T337C |
| pXCS617 | Q34C, G471C; L142C, N371C |
| pXCS618 | L142C, N371C; S35C, G471C |
| pXCS619 | L142C, N371C; S62C, I199C |
| pXCS620 | L142C, N371C; S155C, S290C |
| pXCS621 | L142C, N371C; T397C, P484C |
| pXCS622 | L142C, N371C; T397C, E487C |
| pXCS623 | L142C, N371C; L410C, S466C |
| pXCS624 | L142C, N371C; S443C, S466C |
| pXCS625 | R106C, V144C; S62C, I199C |
| pXCS626 | R106C, V144C; T397C, E487C |
| pXCS627 | R106C, V144C; L410C, S466C |
| pXCS628 | S55C, L188C; L138C, T337C |
| pXCS629 | S55C, L188C; G145C, M370C |
| pXCS630 | T103C, I148C; L138C, T337C |
| pXCS712 | S55C, L188C; R106C, V144C; L142C, N371C |
| pXCS517 | S62C, D200C |
| pXCS530 | S155C, I288C |
| pXCS533 | L158C, I291C |
| pXCS552 | S155C, S290C; L410C, G464C |
| pXCS555 | S155C, S290C; R106C, V144C |

TABLE 2

Exemplary RSV F Protein Mutants Comprising Cavity Filling Mutations

| Mutant ID | Mutations |
| --- | --- |
| pXCS559 | S55I |
| pXCS560 | S55Y |
| pXCS561 | S62L |
| pXCS562 | S62Y |
| pXCS563 | S155H |
| pXCS564 | S155Y |
| pXCS565 | S190I |
| pXCS566 | S190M |
| pXCS567 | S190Y |
| pXCS568 | S290H |
| pXCS569 | S290M |
| pXCS570 | S290Y |
| pXCS571 | T54H |
| pXCS572 | T54I |
| pXCS573 | T58L |
| pXCS574 | T58M |
| pXCS575 | T189I |
| pXCS577 | T219I |
| pXCS578 | T219M |
| pXCS579 | T397I |
| pXCS580 | T397Y |
| pXCS581 | G151A |
| pXCS582 | G151H |
| pXCS583 | A147H |
| pXCS584 | A147I |
| pXCS585 | A298L |
| pXCS586 | A298M |
| pXCS587 | V164I |
| pXCS588 | V187I |
| pXCS589 | V192H |
| pXCS590 | V207I |
| pXCS591 | V220I |
| pXCS592 | V296I |
| pXCS593 | V300I |
| pXCS594 | V495Y |
| pXCS595 | R106W |
| pXCS666 | S190F, V207L |
| pXCS691 | V495Y, S62L |
| pXCS692 | V495Y, T219M |
| pXCS693 | V495Y, T54H |
| pXCS694 | V495Y, T58L |
| pXCS695 | V495Y, V164I |
| pXCS696 | V495Y, V187I |
| pXCS697 | V495Y, V296I |
| pXCS698 | V296I, S62L |
| pXCS699 | V296I, T219M |
| pXCS700 | V296I, T54H |
| pXCS701 | T54H, S62L |
| pXCS702 | T54H, T219M |
| pXCS711 | F488W |
| pXCS576 | T189Y |

TABLE 3

Exemplary RSV F Protein Mutants Comprising Electrostatic Mutations

| Mutant ID | Mutations |
| --- | --- |
| pXCS631 | E82Q |
| pXCS632 | E82S |
| pXCS633 | E82L |
| pXCS634 | E92D |
| pXCS635 | E92T |
| pXCS636 | E92Q |
| pXCS637 | E92F |
| pXCS638 | R106Q |
| pXCS639 | R106N |
| pXCS640 | R106F |
| pXCS641 | K315F |
| pXCS642 | K315L |
| pXCS643 | K315I |
| pXCS644 | K315Q |
| pXCS645 | R339Q |
| pXCS646 | R339W |
| pXCS647 | R339F |
| pXCS648 | D392N |
| pXCS649 | D392S |
| pXCS650 | D392P |
| pXCS651 | K394M |
| pXCS652 | K394T |
| pXCS653 | K394F |
| pXCS654 | K399R |
| pXCS655 | K399M |
| pXCS656 | K399S |
| pXCS657 | D486H |
| pXCS658 | D486S |
| pXCS659 | D486T |
| pXCS660 | E487Q |
| pXCS661 | E487H |
| pXCS662 | E487D |
| pXCS663 | D489H |
| pXCS664 | D489S |
| pXCS665 | D489N |

TABLE 4

Exemplary RSV F Protein Mutants Comprising Engineered Disulfide Mutations and Cavity Filling Mutations

| Mutant ID | Mutations |
| --- | --- |
| pXCS667 | R106C-V144C; S443C-S466C; S55I |
| pXCS668 | R106C-V144C; L142C-N371C; S55I |
| pXCS669 | R106C-V144C; T397C-P484C; S55I |
| pXCS670 | R106C-V144C; S443C-S466C; T54H |
| pXCS671 | R106C-V144C; L142C-N371C; T54H |
| pXCS672 | R106C-V144C; T397C-P484C; T54H |
| pXCS674 | R106C-V144C L142C-N371C; T54H, S190Y |
| pXCS679 | S62C-I199C; L142C-N371C; S55I |
| pXCS680 | S62C-I199C; L142C-N371C; T54H |
| pXCS683 | Q34C-G471C; L142C-N371C; S62L |
| pXCS684 | Q34C-G471C; L142C-N371C; T219M |
| pXCS685 | Q34C-G471C; L142C-N371C; T54H |
| pXCS686 | Q34C-G471C; L142C-N371C; V164I |
| pXCS687 | Q34C-G471C; L142C-N371C; V187I |
| pXCS688 | Q34C-G471C; L142C-N371C; V296I |
| pXCS689 | Q34C-G471C; L142C-N371C; T397Y |
| pXCS690 | Q34C-G471C; L142C-N371C; V495Y |
| pXCS713 | Q34C-G471C; S155C-S290C; T54H |
| pXCS714 | Q34C-G471C; S155C-S290C; V296I |
| pXCS715 | Q34C-G471C; S155C-S290C; V495Y |
| pXCS716 | Q34C-G471C; S155C-S290C; T54H, V495Y |
| pXCS717 | Q34C-G471C; S155C-S290C; T54H, V296I |
| pXCS718 | Q34C-G471C; S155C-S290C; T54H, V296I, V495Y |
| pXCS719 | Q34C-G471C; S155C-S290C; S190I |
| pXCS720 | S155C-S290C; L410C-S466C; T54H |
| pXCS721 | S155C-S290C; L410C-S466C; V296I |
| pXCS722 | S155C-S290C; L410C-S466C; V495Y |
| pXCS723 | S155C-S290C; L410C-S466C; T54H, V495Y |
| pXCS724 | S155C-S290C; L410C-S466C; T54H, V296I |
| pXCS725 | S155C-S290C; L410C-S466C; T54H, V296I, V495Y |
| pXCS726 | S155C-S290C; L410C-S466C; S190I |
| pXCS727 | R106C-V144C; L142C-N371C; T54H |
| pXCS728 | R106C-V144C; L142C-N371C; V296I |
| pXCS729 | R106C-V144C; L142C-N371C; V495Y |
| pXCS730 | R106C-V144C; L142C-N371C; T54H, V495Y |
| pXCS731 | R106C-V144C; L142C-N371C; T54H, V296I |
| pXCS732 | R106C-V144C; L142C-N371C; T54H, V296I, V495Y |
| pXCS733 | R106C-V144C; L142C-N371C; S190I |
| pXCS734 | S55C-L188C; L142C-N371C; T54H |
| pXCS735 | S55C-L188C; L142C-N371C; V296I |
| pXCS736 | S55C-L188C; L142C-N371C; V495Y |
| pXCS737 | S55C-L188C; L142C-N371C; T54H, V495Y |
| pXCS738 | S55C-L188C; L142C-N371C; T54H, V296I |
| pXCS739 | S55C-L188C; L142C-N371C; T54H, V296I, V495Y |
| pXCS740 | S55C-L188C; L142C-N371C; S190I |
| pXCS741 | Q34C-G471C; S55C-L188C; T54H |
| pXCS742 | Q34C-G471C; S55C-L188C; V296I |
| pXCS743 | Q34C-G471C; S55C-L188C; V495Y |
| pXCS744 | Q34C-G471C; S55C-L188C; T54H, V495Y |
| pXCS745 | Q34C-G471C; S55C-L188C; T54H, V296I |
| pXCS746 | Q34C-G471C; S55C-L188C; T54H, V296I, V495Y |
| pXCS747 | Q34C-G471C; S55C-L188C; S190I |
| pXCS748 | T103C-I148C; T54H |
| pXCS749 | T103C-I148C; V296I |
| pXCS750 | T103C-I148C; V495Y |
| pXCS751 | T103C-I148C; T54H, V495Y |
| pXCS752 | T103C-I148C; T54H, V296I |
| pXCS753 | T103C-I148C; T54H, V296I, V495Y |
| pXCS754 | T103C-I148C; S190I |
| pXCS781 | S55C-L188C; T54H |
| pXCS782 | S55C-L188C; V296I |
| pXCS783 | S55C-L188C; V495Y |
| pXCS784 | S55C-L188C; T54H, V495Y |
| pXCS785 | S55C-L188C; T54H, V296I |
| pXCS786 | S55C-L188C; T54H, V296I, V495Y |
| pXCS787 | S55C-L188C; S190I |
| pXCS789 | R106C-V144C; T54H |
| pXCS790 | R106C-V144C; V296I |
| pXCS791 | R106C-V144C; V495Y |
| pXCS792 | R106C-V144C; T54H, V495Y |
| pXCS793 | R106C-V144C; T54H, V296I |
| pXCS794 | R106C-V144C; T54H, V296I, V495Y |
| pXCS795 | R106C-V144C; S190I |
| pXCS797 | L142C-N371C; T54H |
| pXCS798 | L142C-N371C; V296I |
| pXCS799 | L142C-N371C; V495Y |
| pXCS800 | L142C-N371C; T54H, V495Y |
| pXCS801 | L142C-N371C; T54H, V296I |
| pXCS802 | L142C-N371C; T54H, V296I, V495Y |
| pXCS803 | L142C-N371C; S190I |
| pXCS805 | S155C-S290C; T54H |
| pXCS806 | S155C-S290C; V296I |
| pXCS807 | S155C-S290C; V495Y |
| pXCS808 | S155C-S290C; T54H, V495Y |
| pXCS809 | S155C-S290C; T54H, V296I |
| pXCS810 | S155C-S290C; T54H, V296I, V495Y |
| pXCS811 | S155C-S290C; S190I |
| pXCS812 | Q34C-G471C; S155C-S290C; T54H, S190I |
| pXCS815 | S155C-S290C; L410C-S466C; T54H, S190I |
| pXCS818 | R106C-V144C; L142C-N371C; T54H, S190I |
| pXCS821 | S55C-L188C; L142C-N371C; T54H, S190I |
| pXCS827 | T103C-I148C; T54H, S190I |
| pXCS828 | T103C-I148C; S190I, V495Y |
| pXCS830 | S55C-L188C; T54H, S190I |
| pXCS831 | S55C-L188C; S190I, V495Y |
| pXCS833 | R106C-V144C; T54H, S190I |
| pXCS834 | R106C-V144C; S190I, V495Y |
| pXCS836 | L142C-N371C; T54H, S190I |
| pXCS837 | L142C-N371C; S190I, V495Y |
| pXCS839 | S155C-S290C; T54H, S190I |
| pXCS840 | S155C-S290C; S190I, V495Y |
| pXCS889 | T103C-I148C; S190I, V296I |
| pXCS890 | T103C-I148C; T54H, S190I, V296I |
| pXCS891 | S55C-L188C; S190I, V296I |

TABLE 4-continued

Exemplary RSV F Protein Mutants Comprising Engineered Disulfide Mutations and Cavity Filling Mutations

| Mutant ID | Mutations |
|---|---|
| pXCS892 | S55C-L188C; T54H, S190I, V296I |
| pXCS893 | R106C-V144C; S190I, V296I |
| pXCS894 | R106C-V144C; T54H, S190I, V296I |
| pXCS895 | L142C-N371C; S190I, V296I |
| pXCS896 | L142C-N371C; T54H, S190I, V296I |
| pXCS897 | S155C-S290C; S190I, V296I |
| pXCS898 | S155C-S290C; T54H, S190I, V296I |

TABLE 5

Exemplary RSV F Protein Mutants Comprising Engineered Disulfide Mutations and Electrostatic Mutations.

| Mutant ID | Mutations |
|---|---|
| pXCS755 | Q34C-G471C; S155C-S290C; D486S |
| pXCS756 | S155C-S290C; L410C-S466C; D486S |
| pXCS757 | R106C-V144C; L142C-N371C; D486S |
| pXCS758 | S55C-L188C; L142C-N371C; D486S |
| pXCS759 | Q34C-G471C; S55C-L188C; D486S |
| pXCS760 | T103C-I148C; D486S |
| pXCS770 | Q34C-G471C; S155C-S290C; D486S, E487Q |
| pXCS771 | Q34C-G471C; S155C-S290C; D486S, D489S |
| pXCS772 | Q34C-G471C; S155C-S290C; D486S, E487Q, D489S |
| pXCS776 | T103C-I148C; D486S, E487Q |
| pXCS777 | T103C-I148C; D486S, D489S |
| pXCS778 | T103C-I148C; D486S, E487Q, D489S |
| pXCS779 | T103C-I148C; E92D |
| pXCS780 | S55C-L188C; D486S |
| pXCS788 | R106C-V144C; D486S |
| pXCS796 | L142C-N371C; D486S |
| pXCS804 | S155C-S290C; D486S |
| pXCS883 | S55C-L188C; L142C-N371C; D486S, E487Q |
| pXCS884 | S55C-L188C; L142C-N371C; D486S, D489S |
| pXCS885 | S55C-L188C; L142C-N371C; D486S, E487Q, D489S |

TABLE 6

Exemplary RSV F Protein Mutants Comprising a Combination of Engineered Disulfide Mutations, Cavity Filling Mutations, and Electrostatic Mutations.

| Mutant ID | Mutations |
|---|---|
| pXCS761 | Q34C-G471C; S155C-S290C; T54H, D486S, E487Q, D489S, V495Y |
| pXCS762 | Q34C-G471C; S155C-S290C; T54H, V296I, D486S, E487Q, D489S |
| pXCS763 | Q34C-G471C; S155C-S290C; T54H, V296I, D486S, E487Q, D489S, V495Y |
| pXCS764 | Q34C-G471C; S55C-L188C; T54H, D486S, E487Q, D489S, V495Y |
| pXCS765 | Q34C-G471C; S55C-L188C; T54H, V296I, D486S, E487Q, D489S |
| pXCS766 | Q34C-G471C; S55C-L188C; T54H, V296I, D486S, E487Q, D489S, V495Y |
| pXCS767 | R106C-V144C; L142C-N371C; T54H, D486S, E487Q, D489S, V495Y |
| pXCS768 | R106C-V144C; L142C-N371C; T54H, V296I, D486S, E487Q, D489S |
| pXCS769 | R106C-V144C; L142C-N371C; T54H, V296I, D486S, E487Q, D489S, V495Y |
| pXCS773 | T103C-I148C; T54H, D486S, E487Q, D489S, V495Y |
| pXCS774 | T103C-I148C; T54H, V296I, D486S, E487Q, D489S |
| pXCS775 | T103C-I148C; T54H, V296I, D486S, E487Q, D489S, V495Y |
| pXCS842 | T103C-I148C; T54H, S190I, D486S |
| pXCS843 | T103C-I148C; S190I, D486S, V495Y |
| pXCS844 | T103C-I148C; T54H, S190I, D486S, V495Y |
| pXCS845 | T103C-I148C; T54H, D486S |
| pXCS846 | T103C-I148C; D486S, V495Y |
| pXCS847 | T103C-I148C; S190I, D486S |
| pXCS848 | T103C-I148C; V296I, D486S |
| pXCS849 | T103C-I148C; T54H, V296I, D486S |
| pXCS850 | T103C-I148C; S190I, V296I, D486S |
| pXCS851 | T103C-I148C; T54H, S190I, V296I, D486S |
| pXCS852 | S55C-L188C; T54H, D486S |
| pXCS853 | S55C-L188C; S190I, D486S |
| pXCS854 | S55C-L188C; V296I, D486S |
| pXCS855 | S55C-L188C; T54H, S190I, D486S |
| pXCS856 | S55C-L188C; T54H, V296I, D486S |
| pXCS857 | S55C-L188C; S190I, V296I, D486S |
| pXCS858 | S55C-L188C; T54H, S190I, V296I, D486S |
| pXCS859 | R106C-V144C; T54H, D486S |
| pXCS860 | R106C-V144C; S190I, D486S |
| pXCS861 | R106C-V144C; V296I, D486S |
| pXCS862 | R106C-V144C; T54H, S190I, D486S |
| pXCS863 | R106C-V144C; T54H, V296I, D486S |
| pXCS864 | R106C-V144C; S190I, V296I, D486S |
| pXCS865 | R106C-V144C; T54H, S190I, V296I, D486S |
| pXCS866 | L142C-N371C; T54H, D486S |
| pXCS867 | L142C-N371C; S190I, D486S |
| pXCS868 | L142C-N371C; V296I, D486S |
| pXCS869 | L142C-N371C; T54H, S190I, D486S |
| pXCS870 | L142C-N371C; T54H, V296I, D486S |
| pXCS871 | L142C-N371C; S190I, V296I, D486S |
| pXCS872 | L142C-N371C; T54H, S190I, V296I, D486S |
| pXCS873 | S155C-S290C; T54H, D486S |
| pXCS874 | S155C-S290C; S190I, D486S |
| pXCS875 | S155C-S290C; V296I, D486S |
| pXCS876 | S155C-S290C; T54H, S190I, D486S |
| pXCS877 | S155C-S290C; T54H, V296I, D486S |
| pXCS878 | S155C-S290C; S190I, V296I, D486S |
| pXCS879 | S155C-S290C; T54H, S190I, V296I, D486S |
| pXCS880 | S55C-L188C; L142C-N371C; T54H, S190I, D486S, E487Q, D489S |
| pXCS881 | S55C-L188C; L142C-N371C; T54H, V296I, D486S, E487Q, D489S |
| pXCS882 | S55C-L188C; L142C-N371C; T54H, S190I, V296I, D486S, E487Q, D489S |
| pXCS886 | T103C-I148C; T54H, S190I, D486S, E487Q, D489S |
| pXCS888 | T103C-I148C; T54H, S190I, V296I, D486S, E487Q, D489S |

Example 2. RSV F Mutant Expression Vector Construction

A nucleic acid molecule encoding the native RSV A2 F0 polypeptide set forth in SEQ ID NO:1 having the naturally-occurring substitutions P102A, I379V and M447V was mutated using standard molecular biology techniques to encode a precursor polypeptide for a RSV F mutant having desired introduced amino acid mutations. The structure and components of the precursor polypeptide are set forth in FIG. 1 and SEQ ID NO:3. The precursor polypeptide comprises a signal peptide (residues 1-25), F2 polypeptide (residues 26-109), pep27 polypeptide (residues 110-136), F1 polypeptide (residues137-513), T4 fibritin foldon (residues 518-544), thrombin recognition sequence (547-552), purification tags (HIS-tag (residues 553-558)), Strep tag II (residues 561-568), and linker sequences (residues 514-517, 545, 546, 559, and 560).

The protein sequence of SEQ ID NO:3 was submitted for mammalian codon optimization and synthesis by DNA2.0 (Menlo Park, Calif.). The synthesized gene product was introduced into a commercially available expression vector, pcDNA3.1/Zeo(+) (ThermoFisher Scientific, Waltham, Mass.) that had been modified to encode kanamycin resistance instead of ampicillin resistance and to encode the CAG promoter [Niwa, H., Yamamura, K., & Miyazaki, J., Efficient selection for high-expression transfectants with a novel eukaryotic vector. Gene, 108(2), 193-199, 1991] in place of the CMV promoter. Mutagenic oligonucleotides were designed with the QuikChange Primer Design algorithm (Agilent Technologies, Santa Clara, Calif.), and all oligonucleotides were purchased from Integrated DNA Technologies (Coralville, Iowa). Nucleotide substitutions, insertions, and deletions were incorporated with the QuikChange Lightning Multi Site-Directed Mutagenesis Kit (Agilent Technologies). Following digestion of the original plasmid template with DpnI, the mutagenized F allele was re-amplified by polymerase chain reaction (PCR) with high-fidelity Q5 DNA polymerase (New England Biolabs, Ipswich, Mass.) or PrimeSTAR HS (Premix) DNA polymerase (Takara/Clontech, Mountain View, Calif.), and the resulting product was inserted into a mammalian expression vector with the NEBuilder HiFi DNA Assembly Kit (New England Biolabs) or with Gibson Assembly Master Mix (New England Biolabs). The presence of the intended sequence was confirmed by DNA sequencing. Plasmid DNA for transfection into Expi293 cells was purified with the QIAprep Spin MiniPrep Kit (Qiagen, Valencia, Calif.), or with the EndoFree Plasmid Mega Kit (Qiagen). For all commercial kits or reagents, procedures were performed according to the manufacturer's protocol.

Example 3. Expression and Purification of RSV F Protein Mutants

Protein for RSV F protein mutant evaluation was produced by transient transfection of Expi293F cells (Thermo-Fisher, Waltham, Mass.) with DNA constructs assembled and prepared as described in Example 2. Transient transfections were carried out according to the manufacturer's protocol.

Clarified cell culture was concentrated 5-10 fold using tangential flow filtration, followed by buffer exchange into a buffer suitable for capture on a Ni-IMAC column. The conditioned cell culture medium containing soluble F protein was loaded onto a Ni-IMAC column. The product was eluted using increasing concentrations of imidazole. The fractions containing product were pooled and then loaded on a Strep-Tactin column (IBA Life Sciences, Goettingen, Germany). The product was eluted from the Strep-Tactin column using increasing concentrations of desthiobiotin. Fractions containing product were pooled and dialysed into the final storage buffer. The crude culture supernatants and purified proteins were used for in vitro and in vivo assays described herein.

Example 4: Stability of RSV F Protein Mutants

The stability of the designed RSV F protein mutants was evaluated by stress testing and storage stability experiments. During thermal stress testing, crude culture supernatants of the designed mutants were incubated for 1 hour at 50° C. or 60° C. and probed with the pre-fusion specific monoclonal antibody D25 and the pre-fusion trimer-specific antibody AM14 in ELISA assays. The ratio of the antibody reactivity of the stressed versus unstressed sample is defined as the stress resistance parameter. More stable mutants are expected to have higher stress resistance. During storage stability assays, pre-fusion antibody reactivity in crude culture supernatants after 1 week of storage at 4° C. was compared to the reactivity of the fresh culture supernatants. The activity ratio is defined as storage stability of the mutant.

Results are presented in Tables 7A-7C and 8A-8C. Stress resistance was calculated as fractional pre-fusion specific mAb reactivity remaining after stress ("NR"—No Reactivity was detected, "ND"—Not Determined). The most stabilizing amino acid substitutions identified from screens of the individual engineered disulfide mutants, cavity filling mutants and electrostatic mutants (pre-fusion stability defined by D25 reactivity remaining after thermal stress) were combined into the combination mutants. These combination mutants were also subjected to the thermal stress and probed with two monoclonal antibodies—D25 (pre-fusion-specific) and AM14 (pre-fusion trimer-specific). The pre-fusion trimer-specific quaternary epitope recognized by the AM14 antibody is significantly more sensitive to thermal stress than the D25 epitope (Table 8B). No significant AM14 reactivity was retained after 60° C. stress by any of the combination mutants, yet most of the mutants retained D25 reactivity after the 60° C. thermal stress. This observation provides important evidence that the AM14 antibody is a much more precise indicator of pre-fusion structure loss, and particularly loss of the pre-fusion trimeric state.

TABLE 7A

Thermal and storage stability for mutants containing engineered disulfides

| Mutant ID | 50° C. stress resistance, D25 | 60° C. stress resistance, D25 | Storage stability |
|---|---|---|---|
| pXCS507 | 0.45 ± 0.09 | <0.05 | 0.58 |
| pXCS519 | 1.07 ± 0.18 | NR | 0.75 |
| pXCS524 | 0.64 ± 0.08 | NR | 1.00 |
| pXCS544 | 0.52 ± 0.04 | NR | 0.76 |
| pXCS545 | 0.97 ± 0.12 | 0.52 ± 0.13 | low expression |
| pXCS546 | 1.11 ± 0.09 | 0.43 ± 0.09 | low expression |
| pXCS547 | 1.00 ± 0.04 | 0.49 ± 0.11 | 0.96 |
| pXCS548 | 1.04 ± 0.08 | 0.45 ± 0.10 | low expression |
| pXCS549 | 0.66 ± 0.09 | 0.24 ± 0.07 | 1.03 |
| pXCS550 | 0.83 ± 0.02 | 0.19 ± 0.04 | 1.06 |
| pXCS551 | 0.72 ± 0.08 | NR | low expression |
| pXCS553 | 1.12 ± 0.08 | 0.33 ± 0.03 | 1.31 |
| pXCS554 | 2.08 ± 0.19 | 0.41 ± 0.08 | low expression |
| pXCS596 | 0.86 ± 0.09 | 0.02 | 0.80 |
| pXCS597 | 0.50 ± 0.05 | 0.05 | 1.07 |
| pXCS598 | 0.75 ± 0.03 | 0.13 ± 0.03 | 1.09 |
| pXCS599 | 0.68 ± 0.10 | 0.02 | 0.95 |
| pXCS600 | 0.87 ± 0.09 | 0.15 ± 0.04 | 0.90 |
| pXCS601 | 0.71 ± 0.08 | 0.04 | 0.57 |
| pXCS602 | 0.75 ± 0.03 | 0.06 ± 0.01 | 0.58 |
| pXCS603 | 0.67 ± 0.06 | 0.12 ± 0.02 | 0.40 |
| pXCS604 | 0.74 ± 0.03 | ND | low expression |
| pXCS605 | 0.71 ± 0.04 | 0.16 ± 0.03 | 0.00 |
| pXCS606 | 0.76 ± 0.06 | NR | low expression |
| pXCS607 | NR | NR | low expression |
| pXCS608 | 0.62 ± 0.14 | NR | 0.00 |
| pXCS609 | 0.76 ± 0.08 | 0.08 ± 0.01 | 0.28 |
| pXCS610 | 0.34 ± 0.06 | NR | 0.00 |
| pXCS611 | 0.35 ± 0.11 | NR | low expression |
| pXCS612 | NR | NR | low expression |
| pXCS613 | 0.3 | NR | 0.00 |
| pXCS617 | 1.04 ± 0.04 | 0.43 ± 0.04 | 0.50 |
| pXCS618 | 1.01 ± 0.07 | 0.30 ± 0.08 | low expression |
| pXCS619 | 1.04 ± 0.08 | 0.34 ± 0.07 | 0.57 |
| pXCS620 | ND | ND | low expression |
| pXCS621 | 0.87 ± 0.03 | 0.14 ± 0.02 | 0.62 |
| pXCS622 | ND | ND | low expression |
| pXCS623 | 0.91 ± 0.03 | 0.26 ± 0.03 | low expression |
| pXCS624 | 0.87 ± 0.06 | 0.18 ± 0.04 | 0.67 |
| pXCS628 | 0.83 ± 0.04 | 0.16 ± 0.02 | 0.71 |
| pXCS629 | 1.01 ± 0.06 | 0.04 ± 0.03 | 1.00 |
| pXCS630 | 0.61 ± 0.04 | NR | 0.00 |

TABLE 7B

Thermal and storage stability of mutants containing cavity filling mutations

| Mutant ID | 50° C. stress resistance, D25 | 60° C. stress resistance, D25 | Storage stability |
|---|---|---|---|
| pXCS565 | 0.61 ± 0.06 | 0.03 ± 0.01 | 0.74 |
| pXCS571 | 0.46 ± 0.05 | NR | 0.81 |
| pXCS592 | 0.38 ± 0.07 | NR | 0.025 |

TABLE 7C

Thermal and storage stability of mutants containing electrostatic mutations

| Mutant ID | 50° C. stress resistance, D25 | 60° C. stress resistance, D25 | Storage stability |
|---|---|---|---|
| pXCS658 | 1.05 ± 0.05 | 0.30 ± 0.03 | 0.71 |
| pXCS660 | 1.03 ± 0.03 | NR | 0.94 |
| pXCS664 | 0.87 ± 0.03 | NR | 0.76 |

TABLE 8A

Thermal and storage stability of mutants containing double combination mutations

| Mutant ID | 50° C. stress resistance, D25 | 60° C. stress resistance, D25 | Storage stability |
|---|---|---|---|
| pXCS674 | 0.73 ± 0.09 | 0.53 ± 0.07 | 1.47 |
| pXCS683 | 1.10 ± 0.02 | 0.4 | low expression |
| pXCS684 | 1.05 ± 0.01 | 0.46 ± 0.04 | low expression |
| pXCS685 | 1.10 ± 0.02 | 0.70 ± 0.06 | low expression |
| pXCS686 | 1.17 ± 0.08 | 0.63 ± 0.05 | low expression |
| pXCS687 | 1.10 ± 0.04 | 0.50 ± 0.03 | low expression |
| pXCS688 | 1.09 ± 0.03 | 0.56 ± 0.08 | low expression |
| pXCS689 | 1.06 ± 0.02 | 0.44 ± 0.07 | low expression |
| pXCS690 | 1.06 ± 0.06 | 0.50 ± 0.03 | 0.27 |
| pXCS693 | 0.70 ± 0.05 | 0.08 ± 0.01 | 0.54 |
| pXCS697 | 0.49 ± 0.04 | 0.06 | low expression |
| pXCS698 | NR | NR | low expression |
| pXCS699 | 0.31 ± 0.05 | NR | low expression |
| pXCS700 | 0.65 ± 0.05 | 0.03 | 0.67 |
| pXCS701 | 0.36 | NR | low expression |
| pXCS702 | 0.48 ± 0.02 | NR | low expression |

TABLE 8B

Thermal and storage stability for mutants containing triple combination mutations

| Mutant ID | 50° C. resistance, AM14 | 60° C. stress resistance, D25 | Storage stability |
|---|---|---|---|
| pXCS734 | 0.61 | 0.31 ± 0.00 | 1.09 ± 0.06 |
| pXCS735 | 0.70 | 0.37 ± 0.04 | 0.73 ± 0.13 |
| pXCS738 | 0.72 | 0.37 | 0.58 ± 0.10 |
| pXCS740 | 0.69 | 0.41 ± 0.06 | 1.03 ± 0.11 |
| pXCS749 | ND | 0.00 ± 0.10 | 0.65 ± 0.15 |
| pXCS752 | ND | 0.00 ± 0.10 | 0.62 ± 0.05 |
| pXCS754 | ND | 0.00 ± 0.10 | 1.19 ± 0.06 |
| pXCS758 | 0.70 | 0.22 ± 0.04 | 1.32 ± 0.03 |
| pXCS760 | ND | 0.82 ± 0.04 | 0.66 ± 0.22 |
| pXCS774 | 1.00 ± 0.16 | 0.74 ± 0.03 | 0.74 ± 0.10 |
| pXCS776 | 1.40 ± 0.21 | 1.08 ± 0.09 | 0.30 ± 0.16 |
| pXCS777 | 1.03 ± 0.17 | 1.17 ± 0.05 | 0.54 ± 0.21 |
| pXCS778 | 1.14 ± 0.18 | 0.36 ± 0.07 | 0.34 ± 0.06 |
| pXCS779 | 0.85 ± 0.15 | 0.00 ± 0.10 | 0.51 ± 0.08 |
| pXCS780 | 0.70 ± 0.17 | 0.11 ± 0.00 | 0.82 ± 0.08 |
| pXCS781 | 0.88 ± 0.17 | 0.00 ± 0.10 | 0.94 ± 0.05 |
| pXCS782 | 0.55 ± 0.18 | 0.07 ± 0.01 | 0.67 ± 0.13 |
| pXCS785 | 1.01 ± 0.18 | 0.00 ± 0.10 | 1.08 ± 0.18 |

TABLE 8B-continued

Thermal and storage stability for mutants containing triple combination mutations

| Mutant ID | 50° C. resistance, AM14 | 60° C. stress resistance, D25 | Storage stability |
|---|---|---|---|
| pXCS787 | 0.82 ± 0.17 | 0.14 ± 0.01 | 0.82 ± 0.19 |
| pXCS804 | 0.79 ± 0.11 | 0.19 ± 0.01 | 0.98 ± 0.08 |
| pXCS805 | 0.72 ± 0.15 | 0.24 ± 0.01 | 0.78 ± 0.24 |
| pXCS806 | 0.40 ± 0.13 | 0.16 ± 0.03 | 0.79 ± 0.13 |
| pXCS809 | 0.84 ± 0.12 | 0.29 ± 0.04 | 0.82 ± 0.11 |
| pXCS811 | 0.67 ± 0.10 | 0.30 ± 0.04 | 1.03 ± 0.16 |
| pXCS827 | 0.88 ± 0.07 | 0.06 | 0.50 ± 0.10 |
| pXCS830 | 1.01 ± 0.15 | 0.14 ± 0.02 | 0.53 ± 0.10 |
| pXCS839 | 0.82 ± 0.06 | 0.55 ± 0.03 | 0.57 ± 0.14 |
| pXCS842 | 0.87 ± 0.14 | 0.88 ± 0.02 | 0.57 ± 0.10 |
| pXCS845 | 1.00 ± 0.11 | 1.11 ± 0.11 | 0.50 ± 0.20 |
| pXCS847 | 0.92 ± 0.14 | 0.74 ± 0.01 | 0.54 ± 0.11 |
| pXCS848 | 1.24 ± 0.12 | 1.00 ± 0.03 | 0.15 ± 0.29 |
| pXCS849 | 0.92 ± 0.30 | 1.08 ± 0.10 | 0.59 ± 0.14 |
| pXCS850 | 0.88 ± 0.22 | 0.70 ± 0.01 | 0.75 ± 0.16 |
| pXCS851 | 0.95 ± 0.09 | 0.84 ± 0.05 | 0.79 ± 0.10 |
| pXCS852 | 0.86 ± 0.13 | 0.78 ± 0.02 | 0.89 ± 0.03 |
| pXCS853 | 0.98 ± 0.10 | 0.10 ± 0.01 | 0.53 ± 0.11 |
| pXCS854 | 0.93 ± 0.08 | 0.08 ± 0.01 | 0.55 ± 0.14 |
| pXCS855 | 0.94 ± 0.10 | 0.81 ± 0.07 | 0.53 ± 0.10 |
| pXCS856 | 0.97 ± 0.10 | 0.78 ± 0.00 | 0.59 ± 0.12 |
| pXCS857 | 0.90 ± 0.14 | 0.11 | 0.91 ± 0.07 |
| pXCS858 | 0.95 ± 0.10 | 0.78 ± 0.08 | 0.94 ± 0.06 |
| pXCS873 | 0.77 ± 0.22 | 1.11 ± 0.01 | 0.36 ± 0.13 |
| pXCS874 | 0.93 ± 0.20 | 0.46 ± 0.01 | 0.78 ± 0.19 |
| pXCS875 | 0.62 ± 0.16 | 0.23 ± 0.00 | 0.50 ± 0.10 |
| pXCS876 | 0.90 ± 0.20 | 1.06 ± 0.04 | 0.52 ± 0.10 |
| pXCS877 | 0.49 ± 0.20 | 1.09 ± 0.00 | 0.41 ± 0.09 |
| pXCS878 | 0.66 ± 0.16 | 0.40 ± 0.04 | 0.47 ± 0.16 |
| pXCS879 | 0.82 ± 0.20 | 0.84 ± 0.04 | 0.50 ± 0.20 |
| pXCS880 | 0.68 ± 0.20 | 0.87 ± 0.07 | 0.46 ± 0.15 |
| pXCS881 | 0.68 ± 0.23 | 0.92 ± 0.03 | 0.47 ± 0.26 |
| pXCS882 | 0.75 ± 0.21 | 0.94 ± 0.01 | 0.44 ± 0.16 |
| pXCS883 | 0.81 ± 0.13 | 0.40 ± 0.01 | 0.47 ± 0.24 |
| pXCS884 | 0.69 ± 0.15 | 0.43 ± 0.05 | 0.45 ± 0.17 |
| pXCS885 | 0.60 ± 0.21 | 0.47 ± 0.01 | 0.45 ± 0.13 |
| pXCS886 | 0.89 ± 0.13 | 0.70 ± 0.02 | 0.45 ± 0.14 |
| pXCS888 | 0.86 ± 0.14 | 0.81 ± 0.05 | 0.43 ± 0.10 |
| pXCS889 | 0.99 ± 0.14 | 0.00 ± 0.10 | 0.86 ± 0.10 |
| pXCS890 | 0.72 ± 0.34 | 0.10 ± 0.03 | 1.08 ± 0.05 |
| pXCS891 | 0.93 ± 0.06 | 0.08 ± 0.01 | 1.08 ± 0.06 |
| pXCS892 | 0.95 ± 0.13 | 0.18 ± 0.01 | 1.09 ± 0.04 |
| pXCS897 | 0.60 ± 0.28 | 0.42 ± 0.04 | 0.67 ± 0.37 |
| pXCS898 | 0.94 ± 0.46 | 0.48 ± 0.05 | 0.81 ± 0.19 |
| DS-Cav1 | 0.60 | 0.22 | 0.90 |

TABLE 8C

Thermal stability of a mutant devoid of a foldon trimerization domain (pXCS899)

| Mutant ID | 50° C. resistance, AM14 | 60° C. stress resistance, AM14 | 50° C. resistance, D25 | 60° C. stress resistance, D25 |
|---|---|---|---|---|
| pXCS899 | 0.684 | 0.323 | 0.906 | 0.287 |

Example 5: Conformational Integrity of RSV F Protein Mutants Evaluated with a Panel of Monoclonal Antibodies The purpose of the study was to identify RSV F protein mutants that maintain the structural integrity of a RSV-F pre-fusion conformation, including a pre-fusion trimer conformation and association. Each mutant was tested against a panel of reference mAbs that includes two site ϕ- and pre-fusion-specific mAbs (AM22 and D25), one mAb that binds an epitope close to site II is also pre-fusion-specific (MPE8), one site II-specific mAb that binds both pre-fusion and post-fusion F (palivizumab, Synagis®), one pre-fusion trimer-specific mAb (AM14) and a site IV-specific antibody that binds both pre-fusion and post-fusion F (101F). RSV F protein mutants maintained in a pre-fusion conformation were expected to bind all the reference antibodies tested.

The OCTET HTX (ForteBio, Pall Corporation, Port Washington, N.Y.) instrument, which measures kinetics of real-time biomolecular interactions, was used to evaluate the antibody reactivity for each mutant. Experiments were conducted with 1000 rpm agitation, at 30° C. temperature in 96-well black plates (Greiner Bio-One, Monroe, N.C.) with a final volume of 200 μL per well. Anti-HIS biosensor tips were equilibrated in phosphate-buffered saline (PBS), 2% bovine serum albumin (BSA), 0.05% Tween 20 (PBT) for 10 min before commencing binding measurements. HIS-tagged mutant proteins were captured by anti-HIS biosensors for 5 min. Baseline was established in PBT for 3 min before the association step with 20 nM antibodies in PBT for 10 min. Dissociation of all antibodies was allowed for 20 min in the same wells used to establish baseline. OCTET data analysis software (version 8.2, Pall Corp.) was used for kinetic analysis, based on curve fitting of association and dissociation steps, and assuming 1:1 reversible binding interaction. Binding responses (nm shift) for each of the mutants with various reference monoclonal antibodies are presented in Tables 9A and 9B. A response value <0.10 was considered negative and is the limit of detection (LOD) for this assay. Values ≥0.10 were considered positive and indicated antibody binding to individual mutants. Varying degrees of binding were observed across the mutants and with each antibody. However, the majority of combination mutants were bound by 101F and Synagis whereas mutants such as pXCS735 and pXCS776 for example showed loss of binding to at least one pre-fusion-specific mAb. Loss of binding indicated lack of an intact pre-fusion conformation.

TABLE 9A

OCTET Results for Pre-Fusion-Specific Antibodies

| Mutant ID | Response (nm shift) AM22 | D25 | MPE8 | AM14 |
|---|---|---|---|---|
| pXCS734 | 0.284 | 0.590 | 0.818 | 0.931 |
| pXCS735 | LoD | 0.302 | 0.375 | 0.442 |
| pXCS738 | 0.273 | 0.545 | 0.741 | 0.899 |
| pXCS740 | 0.172 | 0.422 | 0.546 | 0.524 |
| pXCS749 | LoD | 0.153 | 0.206 | 0.178 |
| pXCS752 | 0.234 | 0.463 | 0.703 | 0.641 |
| pXCS754 | 0.298 | 0.562 | 0.676 | 0.816 |
| pXCS758 | 0.273 | 0.589 | 0.816 | 0.772 |
| pXCS760 | 0.121 | 0.176 | 0.151 | 0.203 |
| pXCS774 | 0.340 | 0.595 | 0.795 | 0.738 |
| pXCS776 | LoD | LoD | 0.127 | LoD |
| pXCS777 | 0.121 | 0.201 | 0.270 | 0.285 |
| pXCS778 | LoD | LoD | LoD | 0.121 |
| pXCS779 | 0.125 | 0.200 | 0.232 | 0.329 |
| pXCS780 | 0.290 | 0.495 | 0.608 | 0.684 |
| pXCS781 | 0.423 | 0.666 | 0.876 | 1.053 |
| pXCS782 | 0.222 | 0.378 | 0.513 | 0.580 |
| pXCS785 | 0.465 | 0.727 | 0.937 | 0.955 |
| pXCS787 | 0.225 | 0.464 | 0.621 | 0.445 |
| pXCS804 | 0.267 | 0.432 | 0.605 | 0.522 |
| pXCS805 | 0.173 | 0.282 | 0.443 | 0.355 |
| pXCS806 | 0.152 | 0.252 | 0.347 | 0.330 |
| pXCS809 | 0.185 | 0.281 | 0.392 | 0.444 |
| pXCS811 | 0.322 | 0.490 | 0.638 | 0.714 |
| pXCS827 | 0.450 | 0.692 | 0.880 | 0.881 |
| pXCS830 | 0.465 | 0.707 | 0.923 | 0.878 |
| pXCS839 | 0.390 | 0.593 | 0.782 | 0.731 |
| pXCS842 | 0.493 | 0.780 | 0.932 | 0.930 |

TABLE 9A-continued

OCTET Results for Pre-Fusion-Specific Antibodies

| Mutant ID | Response (nm shift) AM22 | D25 | MPE8 | AM14 |
|---|---|---|---|---|
| pXCS845 | 0.314 | 0.495 | 0.699 | 0.653 |
| pXCS847 | 0.484 | 0.732 | 0.871 | 0.935 |
| pXCS848 | 0.109 | 0.188 | 0.266 | 0.235 |
| pXCS849 | 0.430 | 0.668 | 0.908 | 0.886 |
| pXCS850 | 0.517 | 0.839 | 1.038 | 1.018 |
| pXCS851 | 0.508 | 0.824 | 1.025 | 1.027 |
| pXCS852 | 0.565 | 0.881 | 1.126 | 1.144 |
| pXCS853 | 0.484 | 0.746 | 0.905 | 0.883 |
| pXCS854 | 0.453 | 0.693 | 0.886 | 0.884 |
| pXCS855 | 0.523 | 0.778 | 0.982 | 0.992 |
| pXCS856 | 0.568 | 0.827 | 1.063 | 1.094 |
| pXCS857 | 0.563 | 0.890 | 1.091 | 1.110 |
| pXCS858 | 0.547 | 0.840 | 1.061 | 1.097 |
| pXCS873 | 0.192 | 0.398 | 0.537 | 0.434 |
| pXCS874 | 0.444 | 0.681 | 0.851 | 0.771 |
| pXCS875 | 0.205 | 0.459 | 0.623 | 0.540 |
| pXCS876 | 0.268 | 0.523 | 0.702 | 0.600 |
| pXCS877 | 0.213 | 0.419 | 0.573 | 0.525 |
| pXCS878 | 0.324 | 0.666 | 0.812 | 0.833 |
| pXCS879 | 0.351 | 0.680 | 0.826 | 0.804 |
| pXCS880 | 0.213 | 0.563 | 0.684 | 0.505 |
| pXCS881 | 0.178 | 0.556 | 0.763 | 0.623 |
| pXCS882 | 0.219 | 0.516 | 0.691 | 0.463 |
| pXCS883 | 0.233 | 0.553 | 0.704 | 0.484 |
| pXCS884 | 0.323 | 0.576 | 0.784 | 0.714 |
| pXCS885 | 0.105 | 0.327 | 0.408 | 0.239 |
| pXCS886 | 0.443 | 0.715 | 0.863 | 0.872 |
| pXCS888 | 0.434 | 0.726 | 0.878 | 0.875 |
| pXCS889 | 0.477 | 0.720 | 0.889 | 0.870 |
| pXCS890 | 0.538 | 0.778 | 0.999 | 0.994 |
| pXCS891 | 0.461 | 0.719 | 0.920 | 0.828 |
| pXCS892 | 0.542 | 0.756 | 1.032 | 1.000 |
| pXCS897 | 0.406 | 0.605 | 0.745 | 0.740 |
| pXCS898 | 0.416 | 0.614 | 0.816 | 0.795 |
| DS Cav1 | 0.469 | 0.714 | 0.810 | 0.842 |

Note:
LoD = limit of detection,
ND = not determined

TABLE 9B

OCTET Results for Antibodies 101F and Synagis

| Mutant ID | Response (nm shift) 101F | Synagis |
|---|---|---|
| pXCS734 | 0.843 | 0.653 |
| pXCS735 | 0.813 | 0.560 |
| pXCS738 | 0.774 | 0.519 |
| pXCS740 | 0.759 | 0.611 |
| pXCS749 | 0.629 | 0.480 |
| pXCS752 | 0.739 | 0.520 |
| pXCS754 | 0.665 | 0.394 |
| pXCS758 | 0.743 | 0.431 |
| pXCS760 | 0.345 | 0.334 |
| pXCS774 | 0.742 | 0.530 |
| pXCS776 | 0.139 | 0.123 |
| pXCS777 | 0.389 | 0.329 |
| pXCS778 | 0.118 | 0.124 |
| pXCS779 | 0.340 | 0.286 |
| pXCS780 | 0.623 | 0.471 |
| pXCS781 | 0.786 | 0.536 |
| pXCS782 | 0.615 | 0.468 |
| pXCS785 | 0.763 | 0.580 |
| pXCS787 | 0.615 | 0.547 |
| pXCS804 | 0.788 | 0.574 |
| pXCS805 | 0.810 | 0.598 |
| pXCS806 | 0.865 | 0.621 |
| pXCS809 | 0.687 | 0.554 |

TABLE 9B-continued OCTET Results for Antibodies 101F and Synagis

| | Response (nm shift) | |
|---|---|---|
| Mutant ID | 101F | Synagis |
| pXCS811 | 0.768 | 0.606 |
| pXCS827 | 0.973 | 0.898 |
| pXCS830 | 0.901 | 0.839 |
| pXCS839 | 0.900 | 0.880 |
| pXCS842 | 0.942 | 0.853 |
| pXCS845 | 0.798 | 0.782 |
| pXCS847 | 0.941 | 0.960 |
| pXCS848 | 0.400 | 0.394 |
| pXCS849 | 0.999 | 0.991 |
| pXCS850 | 1.040 | 1.076 |
| pXCS851 | 0.991 | 1.002 |
| pXCS852 | 1.072 | 1.014 |
| pXCS853 | 0.842 | 0.878 |
| pXCS854 | 0.851 | 0.857 |
| pXCS855 | 0.914 | 0.894 |
| pXCS856 | 0.957 | 0.935 |
| pXCS857 | 1.016 | 1.056 |
| pXCS858 | 0.981 | 1.010 |
| pXCS873 | 0.809 | 0.798 |
| pXCS874 | 0.881 | 0.844 |
| pXCS875 | 0.912 | 0.833 |
| pXCS876 | 0.820 | 0.727 |
| pXCS877 | 0.842 | 0.823 |
| pXCS878 | 0.832 | 0.776 |
| pXCS879 | 0.838 | 0.725 |
| pXCS880 | 0.693 | 0.735 |
| pXCS881 | 0.812 | 0.786 |
| pXCS882 | 0.651 | 0.714 |
| pXCS883 | 0.719 | 0.807 |
| pXCS884 | 0.798 | 0.792 |
| pXCS885 | 0.666 | 0.737 |
| pXCS886 | 0.807 | 0.853 |
| pXCS888 | 0.839 | 0.873 |
| pXCS889 | 1.020 | 0.946 |
| pXCS890 | 0.999 | 0.949 |
| pXCS891 | 0.919 | 0.851 |
| pXCS892 | 0.960 | 0.889 |
| pXCS897 | 0.939 | 0.901 |
| pXCS898 | 0.802 | 0.773 |
| DS Cav1 | 0.821 | 0.704 |

Example 6. Molecular Weight and Size Distribution Analysis of Selected Pre-Fusion RSV F Mutants Stabilized pre-fusion F mutants were analyzed by SDS-PAGE followed by western blotting with the RSV F-specific monoclonal antibody L4 [Walsh E E, Cote P T, Fernie B F et al. Analysis of the Respiratory Syncytial Virus Fusion Protein Using Monoclonal and Polyclonal Antibodies. J. Gen. Virol. 76: 505-513, 1986.]. FIG. 2A shows SDS-PAGE mobility profiles for representative mutants pXCS847, pXCS851, pXCS852, and DS-Cav1. In all cases a major band with an apparent molecular weight between 55 and 60 kDa, as expected for the monomeric RSV F mutants, was present under non-reducing conditions. The observed slight change in mobility between DS-Cav1 and mutants pXCS847, pXCS851, and pXCS852 could be due to the nature of the individual disulfide bonds and the resulting effect on the overall compactness of the protein in the unfolded state and accessibility to SDS.

FIG. 2B describes molecular weights and size distributions of the mutants pXCS847, pXCS851, pXCS852, and DS-Cav1 in solution under native conditions. The molecular weights and size distributions were estimated from sedimentation velocity analysis using the analytical ultracentrifuge. Purified protein was centrifuged at 35,000 rpm, at 20° C., and UV absorbance across the sample cells was monitored at 280 nm. Data were fit to the continuous c(s) distributions, assuming the same frictional ratio for all of the sedimenting species in the cell. All proteins sedimented with sedimentation coefficient of ~7.6 S and apparent molecular weight of ~180 kDa, indicating that purified proteins are trimeric in solution. The expected molecular weight of the RSV F trimer, calculated from its amino acid composition is 171 kDa.

Example 7. Circular Dichroism Spectroscopy to Characterize Secondary and Tertiary Structure Integrity of the Designed RSV F Protein Mutants Both far- and near-UV CD spectra were recorded on a Jasco J-810 automated recording spectropolarimeter, equipped with a Peltier-type 6-position temperature-controlled cell holder. Far-UV CD spectra were recorded at 0.10-0.12 mg/ml protein concentration in 1×PBS, pH 7.4, in 1 mm rectangular quartz cells between 200 and 260 nm every 0.1 nm at 100 nm/min, with 3 nm band width. Five spectra were collected and averaged for each sample. Near-UV CD spectra were recorded at 0.4-0.5 mg/ml protein concentration in 1×PBS, pH 7.4, in 1 cm rectangular quartz cells between 250 and 320 nm every 0.1 nm at 100 nm/min, with 3 nm band width. Five spectra were collected and averaged for each sample as well. Data were corrected for the buffer baseline contributions and normalized to either mean residue ellipticity (far-UV CD) or molar ellipticity (near-UV CD), using established relationships.

Figure 3A:
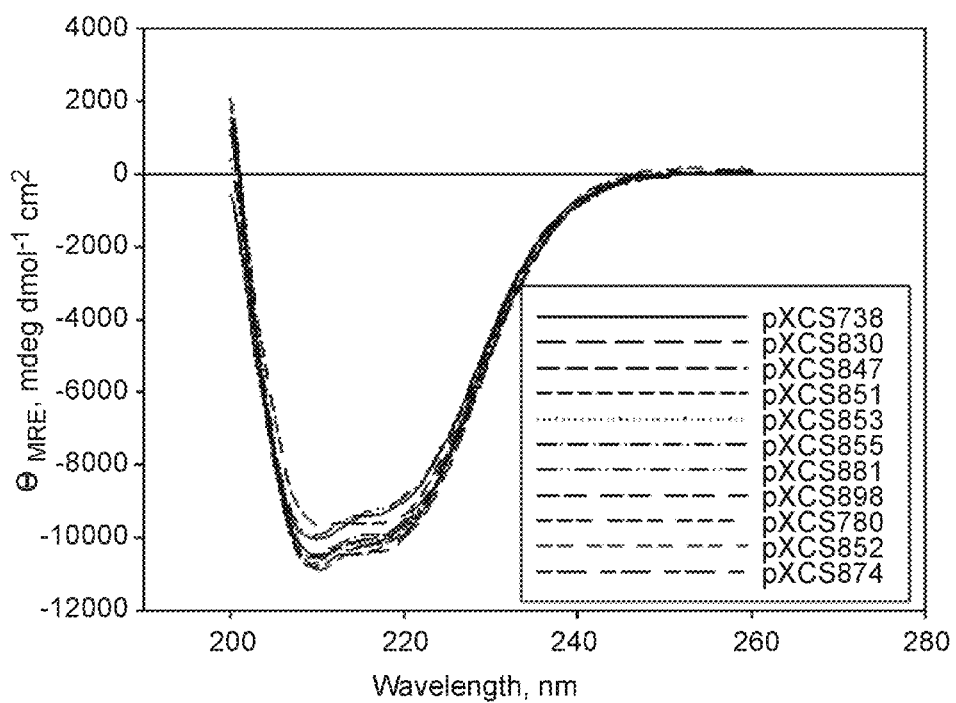
FIGS. 3A and 3B depict the circular dichroism spectroscopy (CD) spectra of exemplary modified RSV F proteins with specific site mutations. The far-ultraviolet (UV) CD spectra of the designed mutants confirm secondary structure integrity, and the near-UV CD spectra confirm tertiary structure integrity.
Figure 3B:
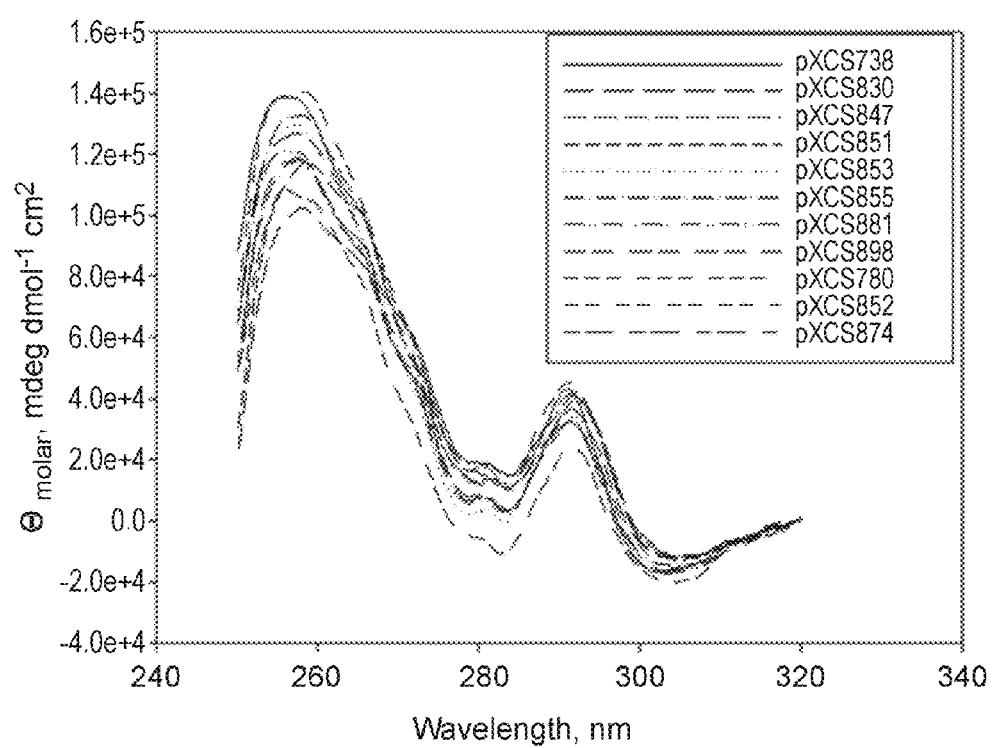

The results are shown in FIGS. 3A and 3B. Both far- and near-UV CD data show that all proteins retain well defined secondary and tertiary structure. Furthermore, obvious similarity of the far- and near-UV CD spectra indicates that overall secondary and tertiary structures of the mutants are similar, and structural integrity of the proteins is preserved.

Example 8. Structural Stability of the Designed RSV F Protein Mutants

The structural stability of the purified RSV F protein mutants was characterized using differential scanning calorimetry (DSC). DSC experiments were conducted on a VP-DSC microcalorimeter (MicroCal, Northampton, Mass.). Protein concentration was determined spectrophotometrically and corrected for light scattering contribution. Protein samples in 1×PBS, pH 7.4 at 0.2-0.5 mg/mL (1.0-2.4 micromolar trimer concentration) were scanned from 10° C. to 80° C. at 90° C./hr, with a response time of 8 seconds and pre-scan equilibration time of 5 minutes. Depending on the number of the observed transitions in thermograms, heat capacity profiles were fit to the 2- or 3-state unfolding models using Origin 7.0 software provided by the DSC manufacturer. Melting temperatures of the first observable transitions are given as melting temperatures of each mutant.

DSC data show almost all of the designed mutants are more stable than DS-Cav1 (Table 10). Melting temperatures (defined as DSC maxima of the first observable DSC peak in each experiment, Table 10) of all mutants (with the exception of pXCS738) are higher than DS-Cav1 by up to 18° C. DSC data show that computational protein design described in Example 1 succeeded in producing significantly more stable RSV F mutants that also retain a pre-fusion conformation (Octet data, Example 5).

TABLE 10

Melting temperatures of RSV F protein mutants.
Melting temperatures were calculated from the DSC experiments
(as described in Example 8).

| Mutant ID | $T_{m1}$, °C. |
|---|---|
| DS-Cav1 | 52.9 ± 0.0 |
| pXCS738 | 52.5 ± 0.1 |
| pXCS780 | 65.2 ± 0.0 |
| pXCS830 | 58.3 ± 0.0 |
| pXCS847 | 68.4 ± 0.0 |
| pXCS851 | 70.4 ± 0.0 |
| pXCS852 | 69.2 ± 0.0 |
| pXCS853 | 65.2 ± 0.0 |
| pXCS855 | 69.3 ± 0.0 |
| pXCS874 | 54.8 ± 1.0 |
| pXCS881 | 70.6 ± 0.0 |
| pXCS898 | 59.6 ± 0.5 |

Example 9. Mechanism of the Pre-Fusion Trimer Conformation Loss

Figure 5:
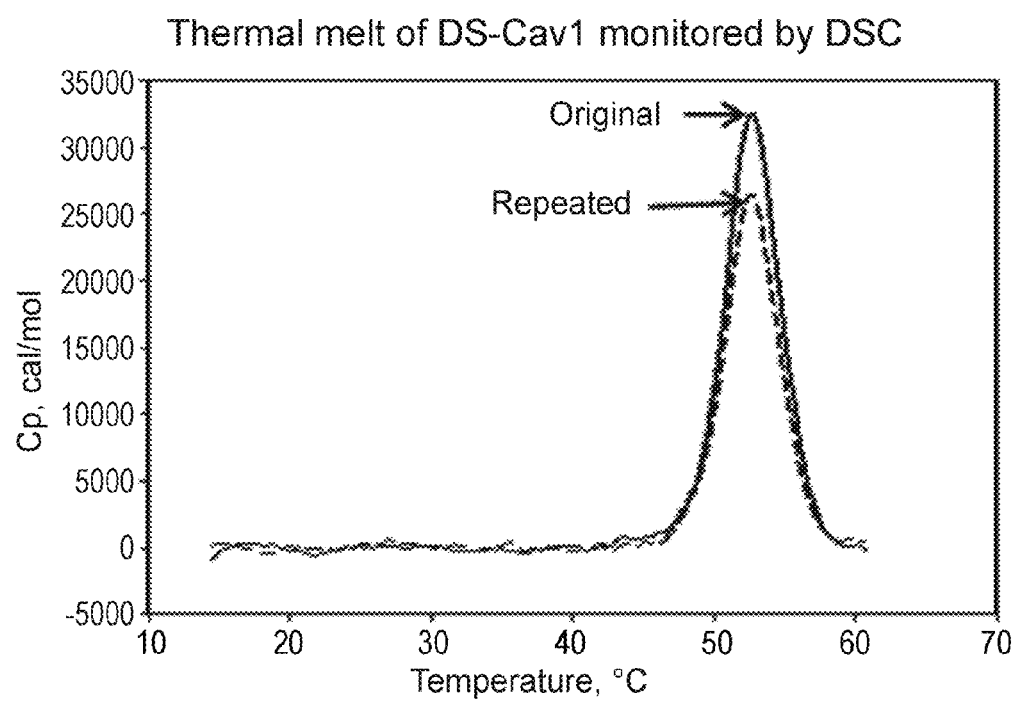
FIG. 5 depicts differential scanning calorimetry (DSC) experiments with purified DS-Cav1 (Example 8). The experiments were done as described for the designed pre-fusion F mutants. Solid line—initial DSC scan of the sample, dashed line—repeat scan of the same sample that was used in the initial scan. The DSC peak largely recovers during the repeated scan, indicating that conformational transition detected by the DSC is reversible.
Figure 6A:
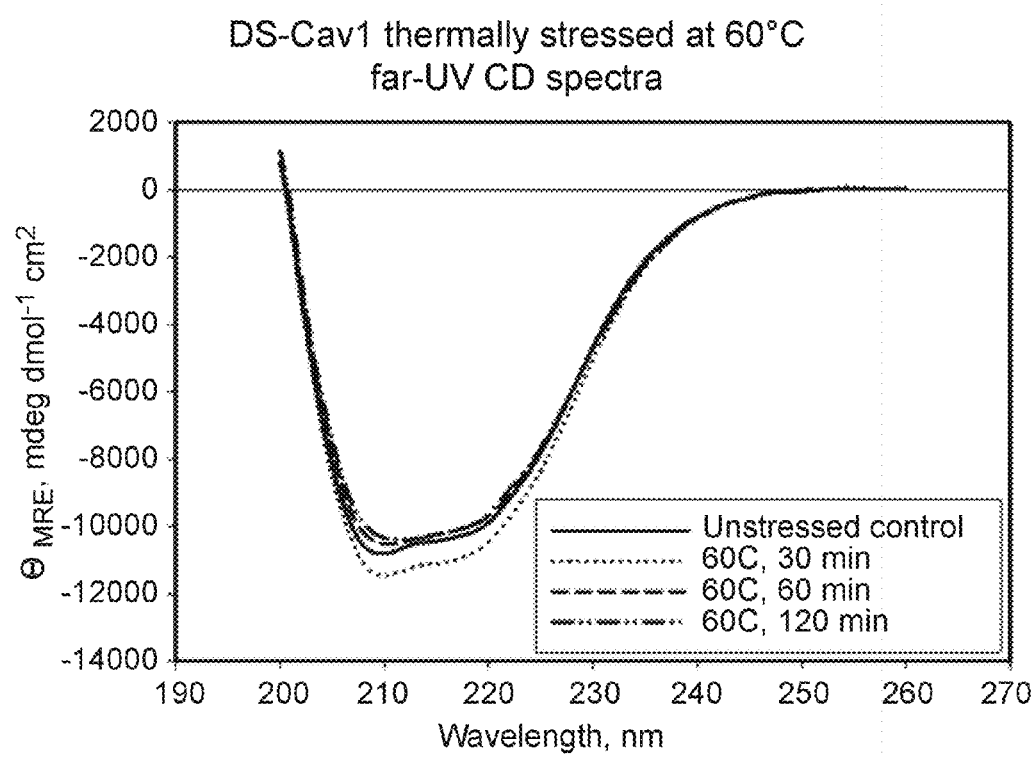
FIG. 6A depicts far-UV CD spectra of DS-Cav1 stressed at 60° C. (Example 8). CD spectra were recorded as described above for the designed pre-fusion RSV F mutants (Example 6). DS-Cav1 retains defined far-UV CD spectrum after up to 2 hours of incubation at 60° C., indicating that no global protein unfolding is taking place during that time.
Figure 6B:
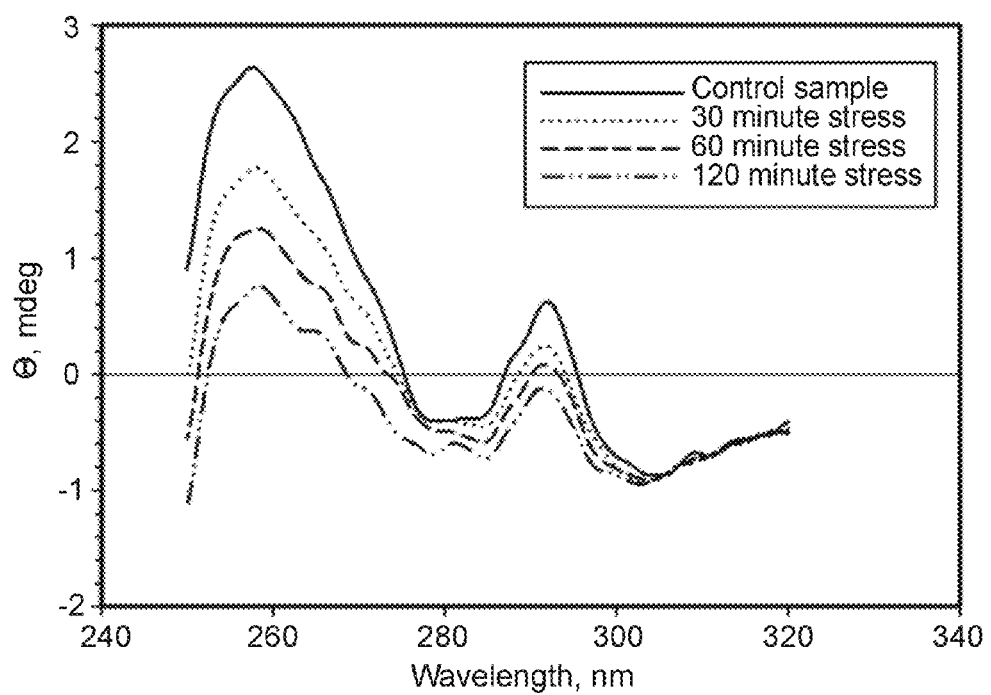
FIG. 6B depicts near-UV CD spectra of DS-Cav1 stressed at 60° C. (Example 8). CD spectra were recorded as described above for the designed pre-fusion RSV F mutants (Example 6).

In order to characterize a specific structural pathway leading to loss of the pre-fusion conformation, we subjected purified DS-Cav1 to thermal stress testing. The purified glycoprotein (0.5 mg/ml in 1×PBS, pH 7.4) was incubated at 50° C. and 60° C. for 30, 60 and 120 minutes. Binding of the pre-fusion-specific mAb D25 and the pre-fusion trimer-specific mAb AM14 to the stressed protein was assessed via ELISA experiments as described in Example 4). The structural integrity of the protein was characterized via CD and DSC as described in Examples 7 and 8, respectively. The results are shown in FIGS. 4-6.

Figure 4:
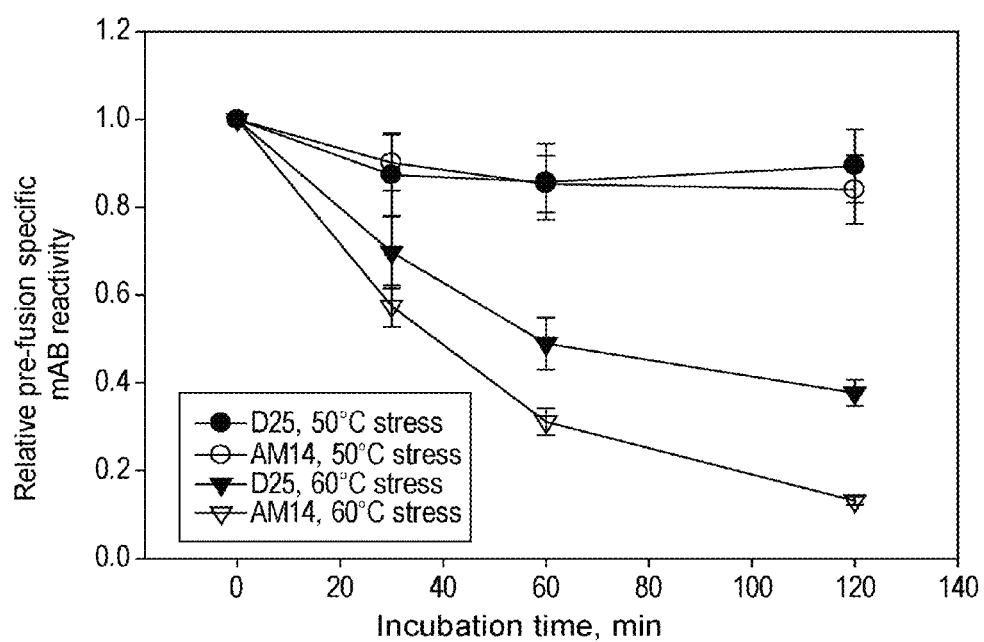
FIG. 4 depicts the time-dependent stress testing of purified DS-Cav1 using two different monoclonal antibodies (mAbs) D25 and AM14 at two temperatures (50° C. and 60° C.).

The relative AM14 and D25 reactivities of the stressed samples are shown in FIG. 4. Both D25 and AM14 reactivity of DS-Cav1 remain largely unchanged after up to 2 hours of incubation at 50° C. In contrast, reactivity to both pre-fusion specific antibodies is progressively lost during 60° C. treatment. Furthermore, AM14 reactivity is lost more quickly than D25 reactivity, indicating that the quaternary pre-fusion AM14 epitope is disrupted earlier than the D25 epitope. The result highlights an advantage of the AM14 antibody as a probe for the detection of the pre-fusion trimer conformation loss.

DSC assessment of the unstressed DS-Cav1 (FIG. 5) shows that the protein undergoes a reversible conformational transition between 50° C. and 60° C. This transition does not correspond to the loss of the pre-fusion conformation, which is irreversible. Furthermore, this transition does not result from the global unfolding of the protein as DS-Cav1 retains defined far- and near-UV CD spectra (FIGS. 6A and 6B), indicating that the protein remains folded under these conditions. The most likely explanation of the observed DSC transition is reversible loss of the quaternary structure of the protein, i.e., at least local dissociation of the pre-fusion trimer. This dissociation is required for the initial steps toward loss of the pre-fusion conformation, since neither AM14 nor D25 reactivity is appreciably lost before that transition takes place (FIG. 4, ELISA data). These data emphasize the importance of trimer integrity for the stability of the pre-fusion conformation. Trimer integrity can only be confirmed by the reactivity against quaternary epitope-specific antibody AM14, but not the site 0 specific antibody D25.

These data suggest that the loss of the pre-fusion conformation occurs via the following pathway:

$$N_3 \leftrightarrow 3N \rightarrow 3U \rightarrow U_n$$

Figure 7A:
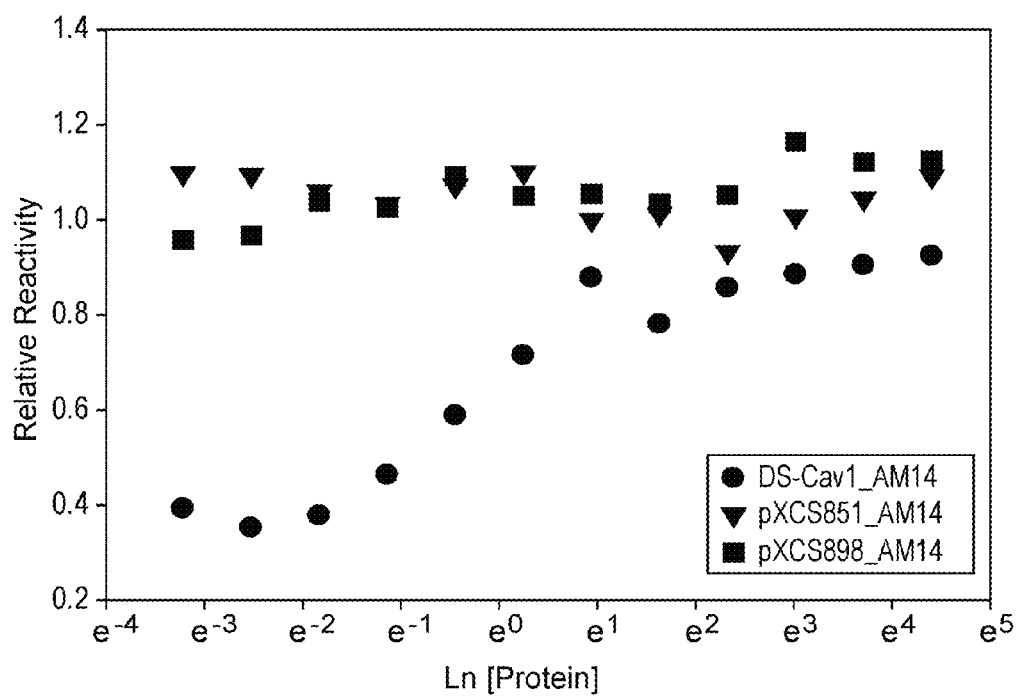
FIG. 7A depicts the protein concentration dependence of thermal stress resistance, as determined by the preservation of the pre-fusion F trimer-specific AM14 epitope (Example 8).
Figure 7B:
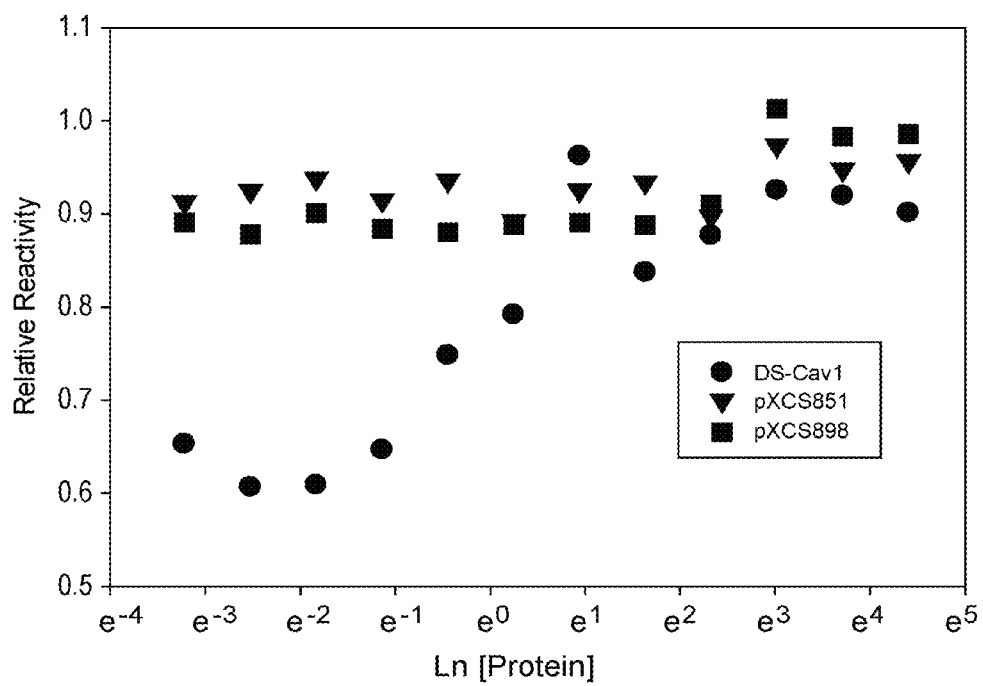
FIG. 7B depicts the protein concentration dependence of thermal stress resistance, as determined by the preservation of the pre-fusion F-specific D25 epitope (Example 8). Protein samples were serially diluted and subjected to the 50° C. stress for 1 hour. D25 reactivity remaining after the stress in relation to the control (unstressed) samples was assessed in ELISA assays.

Native trimer ($N_3$) reversibly dissociates into native monomers (3N), which slowly and irreversibly lose pre-fusion conformation (3U) and ultimately aggregate, forming high molecular mass species ($U_n$). The trimer dissociation, in turn, means that DS-Cav1 will display protein concentration-dependent resistance against thermal stress: a decrease in total protein concentration will promote trimer dissociation, which, in turn, will accelerate pre-fusion conformation loss. In contrast, stabilized pre-fusion F mutants (e.g. 851) should show little to no concentration dependence of their stress resistance, provided they were made sufficiently stable. FIGS. 7A and 7B provide further experimental evidence to support this hypothesis. Protein samples were serially diluted and subjected to 50° C. stress for one hour. AM14 and D25 reactivities remaining after stress in relation to the control (unstressed) samples were assessed in ELISA assays. Stress resistance of DS-Cav1 shows pronounced dependence on protein concentration, as determined by either AM14 (FIG. 7A) or D25 (FIG. 7B) antibody reactivity. In contrast, stress resistance of the stabilized mutants pXCS851 and pXCS898 remains largely unchanged over the same protein concentration range.

Example 10: Stabilized RSV F Protein Mutants in Pre-Fusion Conformation Elicit Neutralizing Antibody Responses in Mice Female Balb/c mice were immunized with either 0.025 µg or 0.25 µg of either DS-Cav1, wild-type F, F mutants pXCS738, pXCS780, pXCS830, pXCS847, pXCS851, pXCS852, pXCS853, pXCS855, pXCS874, pXCS881, or pXCS898, or, with or without 0.1 mg per dose aluminum phosphate (AlPO4) as adjuvant. Immunizations were given intramuscularly at weeks 0 and 3 (Table 11). Pre (week 0) and post-dose 2 (PD2, week 5) sera were evaluated in an RSV subfamily A neutralization assay as described with minor modifications [Eyles J E, Johnson J E, Megati S, et al. Nonreplicating vaccines can protect african green monkeys from the Memphis 37 strain of respiratory syncytial virus. J Inf Dis. 208(2):319-29, 2013.]. Briefly, neutralizing antibody titers were determined as the serum dilution factor resulting in a 50% reduction in infectious units. Results are reported as the geometric mean titer from 10 mice per group. Sera with no detectable virus neutralization were assigned a titer of 20. Fold rise in geometric mean titers are reported as the ratio of post-dose 2 (PD2) to pre-immunization titers within each group.

TABLE 11

Immunization schedule of the murine immunogenicity study comparing pre-fusion F mutants.

| Pre-fusion F Ag dose | 0.025 µg and 0.25 µg with and without AlPO4 (0.1 mg/mL) |
|---|---|
| Vaccination | Weeks 0, 3 |
| Bleed | Weeks 0 (Pre) |
|  | 3 (PD1) |
|  | 5 (PD2) |

Figure 8:
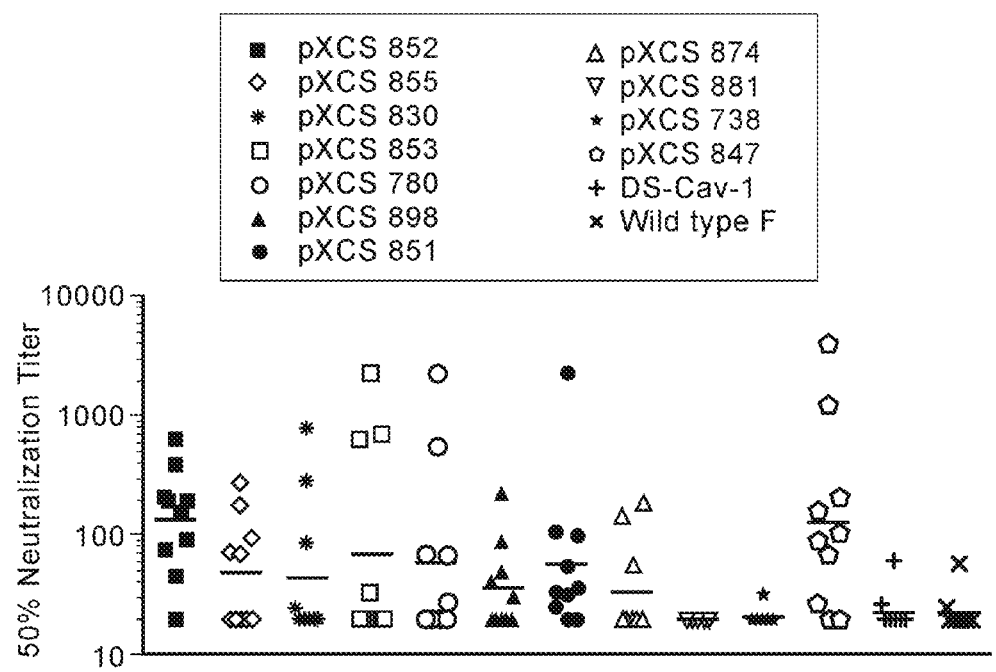
FIG. 8 shows neutralizing antibody responses from mice immunized with DS-Cav1; wild-type F; or mutants pXCS852, pXCS855, pXCS830, pXCS853, pXCS780, pXCS898, pXCS851, pXCS874, pXCS881, pXCS738, or pXCS847; with or without aluminum phosphate as adjuvant. Results are reported as the 50% geometric mean titer (GMT) from 10 mice per group. Each scatter plot reflects the response of individual mice with 10 animals total per group. The line within each group indicates the geometric mean 50% neutralizing antibody titer. "Wild-type F" refers to a wild-type F ectodomain recombinant construct.
Figure 9A:
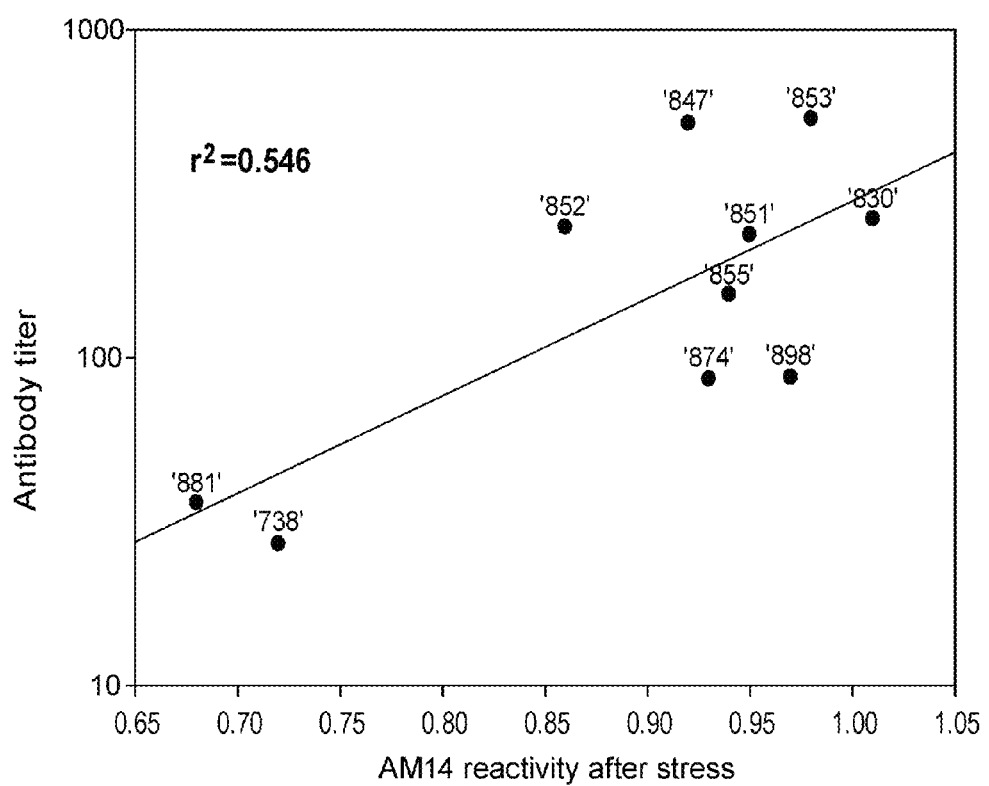
FIGS. 9A and 9B describe correlations between the neutralizing antibody titers elicited by and the stabilities of the engineered pre-fusion F protein mutants. Y-axis—neutralizing antibody titers elicited by immunization of the mice with 0.25 µg antigen and no adjuvant or 0.025 µg antigen with 0.1 mg/ml AlPO4 adjuvant. (Data are shown in Table 12.) X-axis—stability of the engineered mutants, as defined by the residual AM14 reactivity after thermal stress. (Data are shown in Table 8B.)
Figure 9B:
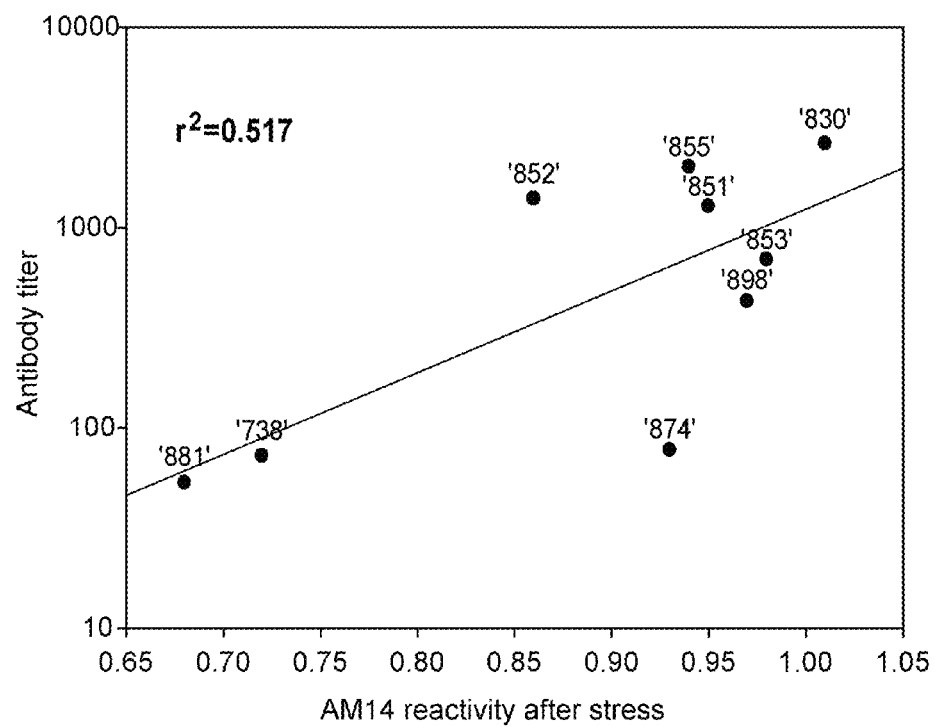

All mutants tested elicited a neutralizing antibody response following two immunizations in mice (Table 12). Overall, antibody titers were consistently higher at both antigen doses for mutants, pXCS830, pXCS847, pXCS851, and pXCS852, demonstrating that these mutants were the more immunogenic forms of a stabilized RSV pre-fusion F glycoprotein (Table 12 and 13, FIG. 8). Comparison of the PD2 50% neutralizing antibody titers with their corresponding mutants' in vitro characterization data shows correlation between the PD2 neutralizing antibody titer and the AM14 thermal stress resistance (FIG. 9). This result suggests that AM14 binding, which is specific for the pre-fusion trimeric state, correlates with the mutants' immunogenicity.

TABLE 12

Geometric mean neutralizing antibody titers of Balb/c mice following immunization with RSV F mutants.

| Mutant ID | 0.025 µg + AlPO4 | | 0.25 µg + AlPO4 | | 0.025 µg No adjuvant | | 0.25 µg No adjuvant | |
|---|---|---|---|---|---|---|---|---|
| | Pre | PD2 | Pre | PD2 | Pre | PD2 | Pre | PD2 |
| pXCS738 | 20 | 72 | 20 | 632 | 20 | 21 | 20 | 27 |
| pXCS780 | 20 | 2373 | 20 | 1311 | 20 | 59 | 20 | 108 |
| pXCS830 | 20 | 2615 | 20 | 3219 | 20 | 45 | 20 | 265 |
| pXCS847 | 20 | ND | 20 | ND | 20 | 129 | 20 | 518 |
| pXCS851 | 20 | 1275 | 20 | 4393 | 20 | 59 | 20 | 237 |
| pXCS852 | 20 | 1388 | 20 | 5100 | 20 | 135 | 20 | 331 |
| pXCS853 | 20 | 690 | 20 | 1225 | 20 | 69 | 20 | 535 |
| pXCS855 | 20 | 2004 | 20 | 1232 | 20 | 49 | 20 | 156 |
| pXCS874 | 20 | 77 | 20 | 2929 | 20 | 34 | 20 | 86 |
| pXCS881 | 20 | 53 | 20 | 2391 | 20 | 20 | 20 | 36 |
| pXCS898 | 20 | 427 | 20 | 2642 | 20 | 39 | 20 | 87 |
| DS-Cav1 | 20 | 271 | 20 | 2319 | 20 | 23 | 20 | 87 |
| Wild type F | 20 | 326 | 20 | 948 | 20 | 23 | 20 | 50 |

ND, not done.

TABLE 13

Fold rise in neutralizing antibody titers of Balb/c mice following immunization with RSV F mutants.

| | 0.025 mg + AlPO4 | 0.25 mg + AlPO4 | 0.025 mg No adjuvant | 0.25 mg No adjuvant |
|---|---|---|---|---|
| pXCS738 | 3.6 | 31.6 | 1.1 | 1.4 |
| pXCS780 | 118.7 | 65.6 | 3.0 | 5.4 |
| pXCS830 | 130.8 | 161.0 | 2.3 | 13.3 |
| pXCS847 | N/A | N/A | 6.5 | 25.9 |
| pXCS851 | 63.8 | 219.7 | 3.0 | 11.9 |
| pXCS852 | 69.4 | 255.0 | 6.8 | 16.6 |
| pXCS853 | 34.5 | 61.3 | 3.5 | 26.8 |
| pXCS855 | 100.2 | 61.6 | 2.5 | 7.8 |
| pXCS874 | 3.9 | 146.5 | 1.7 | 4.3 |
| pXCS881 | 2.7 | 119.6 | 1.0 | 1.8 |
| pXCS898 | 21.4 | 132.1 | 2.0 | 4.4 |
| DS-Cav1 | 13.6 | 116.0 | 1.2 | 4.4 |
| Wild type F | 16.3 | 47.4 | 1.2 | 2.5 |

N/A, not available.

Example 11. RSV F Mutants Comprising Introduced Cysteine Mutations in the HRB Region 11A. Preparation of RSV F Mutants Comprising Introduced Mutations in the HRB Region Representative RSV F mutants that comprise introduced cysteine mutations in the HRB region (approximately amino acids 476-524 of the F0 polypeptide) are provided in Table 14, where the specific mutations in this region in each mutant are noted. In addition to the mutations in the HRB region, each of these mutants also includes introduced mutations S55C, L188C, T54H, and D486S. These mutants were prepared by methods similar to those described in Examples 1-3. In brief, a precursor polypeptide consisting of 545 amino acids was prepared for each mutant, which comprises: (1) amino acids 1-529 of the sequence of SEQ ID NO:1 except for a deletion of 41 amino acids between residues 104 and 144; (2) the introduced mutations (S55C, L188C, T54H, and D486S) outside of the HRB region, (3) a thrombin protease recognition sequence; (4) a foldon domain; (5) a HIS-tag; (6) a Streptag II; (7) linker sequences; and (8) the introduced cysteine mutations as noted. The signal peptide, which comprises amino acids 1-25, was cleaved from the precursor during the expression process. The foldon domain was also cleaved from the mutants, which was achieved by digestion with 500 ug/ml bovine alpha-thrombin (HTI) overnight at room temperature after the expression process.

TABLE 14

Exemplary RSV F protein mutants comprising engineered disulfide mutations in the HRB region

| Mutant ID | Mutations in HRB Region | SEQ ID NO of Amino Acid Sequence of Precursor Polypeptide |
|---|---|---|
| pXCS1106 | K508C, S509C | 272 |
| pXCS1107 | N515C, V516C | 273 |
| pXCS1108 | T522C, T523C | 274 |
| pXCS1109 | K508C, S509C, N515C, V516C | 275 |
| pXCS1110 | K508C, S509C, T522C, T523C | 276 |
| pXCS1111 | N515C, V516C, T522C, T523C | 277 |
| pXCS1112 | K508C, S509C, N515C, V516C, T522C, T523C | 278 |

11B. Stability of RSV F Mutants Comprising Introduced Cysteine Mutations in the HRB Region Stability of RSV F Mutants provided in Table 14 was assessed according to the method described in Example 8 and Example 4. For thermal stability assessment for mutant pXCS1106, purified pXCS1106 protein, from which the foldon had been cleaved, was diluted into conditioned medium at a concentration of 12 µg/mL. Stress resistance for pXC1106 was calculated as fractional pre-fusion specific mAb reactivity remaining after stress. Results are presented in Tables 15 and 16, respectively.

TABLE 15

Melting temperatures of RSV F protein mutants

| Mutant ID | $T_{m1}$, ° C. |
|---|---|
| pXCS1106 | 66.3 |
| pXCS1108 | 66.7 |
| pXCS1109 | 66.5 |
| pXCS1110 | 67.0 |
| pXCS1111 | 66.5 |
| pXCS1112 | 67.2 |

TABLE 16

Thermal stability of RSV F Mutant pXCS1106

| Mutant ID | 50° C. resistance, AM14 | 60° C. stress resistance, AM14 | 50° C. resistance, D25 | 60° C. stress resistance, D25 |
|---|---|---|---|---|
| pXCS1106 | 1.041 | 0.720 | 1.080 | 1.019 |

Listing of Raw Sequences

SEQ ID NO: 1. Amino Acid Sequence of the Full Length F0 of Native RSV A2 (GenBank GI: 138251; Swiss Prot P03420)

MELLILKANAITTILTAVTFCFASGQNITEEFYQSTCSAVSKGYLSALRT
GWYTSVITIELSNIKENKCNGTDAKVKLIKQELDKYKNAVTELQLLMQST
PPTNNRARRELPRFMNYTLNNAKKTNVTLSKKRKRRFLGFLLGVGSAIAS
GVAVSKVLHLEGEVNKIKSALLSTNKAVVSLSNGVSVLTSKVLDLKNYID
KQLLPIVNKQSCSISNIETVIEFQQKNNRLLEITREFSVNAGVTTPVSTY
MLTNSELLSLINDMPITNDQKKLMSNNVQIVRQQSYSIMSIIKEEVLAYV
VQLPLYGVIDTPCWKLHTSPLCTTNTKEGSNICLTRTDRGWYCDNAGSVS
FFPQAETCKVQSNRVFCDTMNSLTLPSEINLCNVDIFNPKYDCKIMTSKT
DVSSSVITSLGAIVSCYGKTKCTASNKNRGIIKTFSNGCDYVSNKGMDTV
SVGNTLYYVNKQEGKSLYVKGEPIINFYDPLVFPSDEFDASISQVNEKIN
QSLAFIRKSDELLHNVNAGKSTTNIMITTIIIVIIVILLS LIAVGLLLY
CKARSTPVTLSKDQLSGINNIAFSN

SEQ ID NO: 2. Amino Acid Sequence of the Full Length F0 of Native RSV B (18537 strain; GenBank GI: 138250; Swiss Prot P13843)

MELLIHRSSAIFLTLAVNALYLTSSQNITEEFYQSTCSAVSRGYFSALRT
GWYTSVITIELSNIKETKCNGTDTKVKLIKQELDKYKNAVTELQLLMQNT
PAANNRARREAPQYMNYTINTTKNLNVSISKKRKRRFLGFLLGVGSAIAS
GIAVSKVLHLEGEVNKIKNALLSTNKAVVSLSNGVSVLTSKVLDLKNYIN
NRLLPIVNQQSCRISNIETVIEFQQMNSRLLEITREFSVNAGVTTPLSTY
MLTNSELLSLINDMPITNDQKKLMSSNVQIVRQQSYSIMSIIKEEVLAYV
VQLPIYGVIDTPCWKLHTSPLCTTNIKEGSNICLTRTDRGWYCDNAGSVS
FFPQADTCKVQSNRVFCDTMNSLTLPSEVSLCNTDIFNSKYDCKIMTSKT
DISSSVITSLGAIVSCYGKTKCTASNKNRGIIKTFSNGCDYVSNKGVDTV
SVGNTLYYVNKLEGKNLYVKGEPIINYYDPLVFPSDEFDASISQVNEKIN
QSLAFIRRSDELLHNVNTGKSTTNIMITTIIIVIIVVLLSLIAIGLLLYC
KAKNTPVTLSKDQLSGINNIAFSK

SEQ ID NO: 3. RSV A2 F Ectodomain with foldon

MELLILKANAITTILTAVTFCFASGQNITEEFYQSTCSAVSKGYLSALRT
GWYTSVITIELSNIKENKCNGTDAKVKLIKQELDKYKNAVTELQLLMQST
PATNNRARRELPRFMNYTLNNAKKTNVTLSKKRKRRFLGFLLGVGSAIAS
GVAVSKVLHLEGEVNKIKSALLSTNKAVVSLSNGVSVLTSKVLDLKNYID
KQLLPIVNKQSCSISNIETVIEFQQKNNRLLEITREFSVNAGVTTPVSTY
MLTNSELLSLINDMPITNDQKKLMSNNVQIVRQQSYSIMSIIKEEVLAYV
VQLPLYGVIDTPCWKLHTSPLCTTNTKEGSNICLTRTDRGWYCDNAGSVS
FFPQAETCKVQSNRVFCDTMNSLTLPSEVNLCNVDIFNPKYDCKIMTSKT
DVSSSVITSLGAIVSCYGKTKCTASNKNRGIIKTFSNGCDYVSNKGVDTV
SVGNTLYYVNKQEGKSLYVKGEPIINFYDPLVFPSDEFDASISQVNEKIN
QSLAFIRKSDELLSAIGGYIPEAPRDGQAYVRKDGEWVLLSTFLGGLVPR
GSHHHHHHGSWSHPQFEK

SEQ ID NO:4: RSV RSVA/Homo sapiens/USA/LA2_21/2013 F (Ontario) Native Amino Acid Sequence (GenBank GI: AHX57185):

MELPILKTNAITTILAAVTLCFASSQNITEEFYQSTCSAVSKGYLSALRT
GWYTSVITIELSNIKENKCNGTDAKVKLIKQELDKYKNAVTELQLLMQST
PAANSRARRELPRFMNYTLNNTKNTNVTLSKKRKRRFLGFLLGVGSAIAS
GIAVSKVLHLEGEVNKIKSALLSTNKAVVSLSNGVSVLTSKVLDLKNYID
KQLLPIVNKQSCSISNIETVIEFQQKNNRLLEITREFSVNAGVTTPVSTY
MLTNSELLSLINDMPITNDQKKLMSSNVQIVRQQSYSIMSIIKEEVLAYW
QLPLYGVIDTPCWKLHTSPLCTTNTKEGSNICLTRTDRGWYCDNAGSVSF
FPQAETCKVQSNRVFCDTMNSLTLPSEVNLCNIDIFNPKYDCKIMTSKTD
VSSSVITSLGAIVSCYGKTKCTASNKNRGIIKTFSNGCDYVSNKGVDTVS
VGNTLYYVNKQEGKSLYVKGEPIINFYDPLVFPSDEFDASISQVNEKINQ
SLAFIRKSDELLHNVNAGKSTTNIMITTIIIVIIVILLALIAVGLLLYCK
ARSTPVTLSKDQLSGINNIAFSN

SEQ ID NO:5: RSV RSV A/Homo sapiens/USA/LA2_21/2013 F Ectodomain with foldon:

MELPILKTNAITTILAAVTLCFASSQNITEEFYQSTCSAVSKGYLSALRT
GWYTSVITIELSNIKENKCNGTDAKVKLIKQELDKYKNAVTELQLLMQST
PAANSRARRELPRFMNYTLNNTKNTNVTLSKKRKRRFLGFLLGVGSAIAS
GIAVSKVLHLEGEVNKIKSALLSTNKAVVSLSNGVSVLTSKVLDLKNYID
KQLLPIVNKQSCSISNIETVIEFQQKNNRLLEITREFSVNAGVTTPVSTY
MLTNSELLSLINDMPITNDQKKLMSSNVQIVRQQSYSIMSIIKEEVLAYV
VQLPLYGVIDTPCWKLHTSPLCTTNTKEGSNICLTRTDRGWYCDNAGSVS
FFPQAETCKVQSNRVFCDTMNSLTLPSEVNLCNIDIFNPKYDCKIMTSKT
DVSSSVITSLGAIVSCYGKTKCTASNKNRGIIKTFSNGCDYVSNKGVDTV
SVGNTLYYVNKQEGKSLYVKGEPIINFYDPLVFPSDEFDASISQVNEKIN
QSLAFIRKSDELLSAIGGYIPEAPRDGQAYVRKDGEWVLLSTFLGGLVPR
GSHHHHHHGSWSHPQFEK

SEQ ID NO:6: RSV RSVB/Homo sapiens/PER/FPP00592/2011 F (Buenos Aires) Native Amino Acid Sequence (GenBank GI: AHV80758):

MELLIHRSSAIFLTLAINALYLTSSQNITEEFYQSTCSAVSRGYFSALRT
GWYTSVITIELSNIKETKCNGTDTKVKLIKQELDKYKNAVTELQLLMQNT
PAANNRARREAPQYMNYTINTTKNLNVSISKKRKRRFLGFLLGVGSAIAS
GIAVSKVLHLEGEVNKIKNALLSTNKAVVSLSNGVSVLTSKVLDLKNYIN
NQLLPIVNQQSCRISNIETVIEFQQKNSRLLEITREFSVNAGVTTPLSTY
MLTNSELLSLINDMPITNDQKKLMSSNVQIVRQQSYSIMSIIKEEVLAYV
VQLPIYGVIDTPCWKLHTSPLCTTNIKEGSNICLTRTDRGWYCDNAGSVS
FFPQADTCKVQSNRVFCDTMNSLTLPSEVSLCNTDIFNSKYDCKIMTSKT
DISSSVITSLGAIVSCYGKTKCTASNKNRGIIKTFSNGCDYVSNKGVDTV

-continued

SVGNTLYYVNKLEGKNLYVKGEPIINYYDPLVFPSDEFDASISQVNEKIN

QSLAFIRRSDELLHNVNTGKSTTNIMITAIIIVIIVVLLSLIAIGLLLYC

KAKNTPVTLSKDQLSGINNIAFSK

SEQ ID NO:7: RSV RSVB/Homo sapiens/PER/FPP00592/2011 F Ectodomain with foldon:

MELLIHRSSAIFLTLAINALYLTSSQNITEEFYQSTCSAVSRGYFSALRT

GWYTSVITIELSNIKETKCNGTDTKVKLIKQELDKYKNAVTELQLLMQNT

PAANNRARREAPQYMNYTINTTKNLNVSISKKRKRRFLGFLLGVGSAIAS

GIAVSKVLHLEGEVNKIKNALLSTNKAVVSLSNGVSVLTSKVLDLKNYIN

NQLLPIVNQQSCRISNIETVIEFQQKNSRLLEITREFSVNAGVTTPLSTY

MLTNSELLSLINDMPITNDQKKLMSSNVQIVRQQSYSIMSIIKEEVLAYV

VQLPIYGVIDTPCWKLHTSPLCTTNIKEGSNICLTRTDRGWYCDNAGSVS

FFPQADTCKVQSNRVFCDTMNSLTLPSEVSLCNTDIFNSKYDCKIMTSKT

DISSSVITSLGAIVSCYGKTKCTASNKNRGIIKTFSNGCDYVSNKGVDTV

SVGNTLYYVNKLEGKNLYVKGEPIINYYDPLVFPSDEFDASISQVNEKIN

QSLAFIRRSDELLSAIGGYIPEAPRDGQAYVRKDGEWVLLSTFLGGLVPR

GSHHHHHHGSWSHPQFEK

SEQ ID NO:8: Nucleotide Sequence Encoding Pre-cursor Polypeptide of pXCS738:

atggaacttctgatcctgaaagccaacgcgattaccactatcctgactgc cgtcaccttctgcttcgcatcgggacagaacattaccgaggagttctacc agtccacctgttcggcggtgtccaagggttacctctcggccctgagaact ggctggtaccactgtgtgattactatcgagctgagcaacatcaaggagaa caagtgcaatggaacggacgcgaaggtcaagctgattaagcaggaactcg ataagtacaagaacgccgtgaccgagctccagctgctgatgcaatcgacc cctgccactaacaacagagctcgccgggaactgccgcgcttcatgaatta cacccctcaacaacgcgaagaaaaccaacgtgaccctgtccaagaagcgca agcggaggttcctgggattcctgtgtggcgtgggctccgcaatcgcatcc ggagtggccgtgtccaaagtgctgcatctggaggggaagtgaacaagat caagtccgccctcctgtcaactaataaggcggtggtgtccctgagcaacg gagtcagcgtgtgtacatccaaggtcctggacctcaagaactacatcgac aagcagctgttgcccatcgtcaacaagcagtcatgctcgattagcaatat cgaaaccgtgattgagttccagcagaagaacaacagactgctcgaaatta cccgggagttttccgtgaacgccgagtgaccactcctgtgtccacctac atgcttacgaactccgaactgctcagcctcatcaacgatatgccgatcac taacgaccagaagaagttgatgagcaacaatgtgcagatcgtgcgccaac agtcctactcaatcatgtcaattatcaaggaggaaatcctcgcctatgtg gtgcaattgcctctgtacggagtcatcgacacacccctgctggaagctgca cactagcccactctgtacgaccaacaccaaggaaggttccaacatctgcc -continued tgactaggaccgatcggggctggtattgcgataatgctgggtccgtgagc ttcttcccgcaagccgagacttgcaaagtgcagtcaaaccgcgtgttctg tgacaccatgtgtagcctgaccctgccatccgaagtcaacctctgcaacg tggacatctttaacccgaaatacgactgcaagattatgacctccaagacc gacgtcagcagctctgtcatcactagcctgggagctattgtgtcctgcta cggaaagaccaaatgcactgcctcgaacaagaacagaggcatcatcaaga ccttcagcaacggctgtgactacgtgtccaacaagggagtggacaccgtg tccgtcgggaacaccctgtactacgtgaacaagcaggaggggaagtcgct ctacgtcaaggggggaaccgattatcaatttctacgaccccctggtgttcc cttccgacgagttcgatgcctccatatcccaagtcaacgagaagatcaac cagtctcttgccttcatccggaagtcggacgaactgctgtccgccatcgg tggctatattccggaagccccagggatggacaggcctacgtgcggaagg atggagaatgggtgcttttgtccaccttcctgggcggtctggtgccccgc ggctcacaccatcatcaccaccacggttcgtggtcccaccctcaatttga gaagtga

[Relevant components (bp coordinates): Signal sequence: 1-75; pep27: 328-408; F1: 409-1539; F2: 76-327; foldon: 1552-1632; Thrombin recognition sequence: 1639-1656; His-tag: 1657-1674; Streptag II: 1681-1704; Linker sequences: 1540-1551, 1633-1638, 1675-1680; P102A (naturally-occurring substitution): 304-306; I379V (naturally-occurring substitution): 1135-1137; M447V (naturally-occurring substitution): 1339-1341; T54H: 160-162; S55C: 163-165; L142C: 424-426; L188C: 562-564; V296I: 886-888; N371C: 1111-1113]

SEQ ID NO:9: Nucleotide Sequence Encoding Precursor Polypeptide of pXCS780:

atggaacttctgatcctgaaagccaacgcgattaccactatcctgactgc cgtcaccttctgcttcgcatcgggacagaacattaccgaggagttctacc agtccacctgttcggcggtgtccaagggttacctctcggccctgagaact ggctggtacacctgtgtgattactatcgagctgagcaacatcaaggagaa caagtgcaatggaacggacgcgaaggtcaagctgattaagcaggaactcg ataagtacaagaacgccgtgaccgagctccagctgctgatgcaatcgacc cctgccactaacaacagagctcgccgggaactgccgcgcttcatgaatta cacccctcaacaacgcgaagaaaaccaacgtgaccctgtccaagaagcgca agcggaggttcctgggattcctgttgggcgtgggctccgcaatcgcatcc ggagtggccgtgtccaaagtgctgcatctggaggggaagtgaacaagat caagtccgccctcctgtcaactaataaggcggtggtgtccctgagcaacg gagtcagcgtgtgtacatccaaggtcctggacctcaagaactacatcgac aagcagctgttgcccatcgtcaacaagcagtcatgctcgattagcaatat cgaaaccgtgattgagttccagcagaagaacaacagactgctcgaaatta cccgggagttttccgtgaacgccgagtgaccactcctgtgtccacctac atgcttacgaactccgaactgctcagcctcatcaacgatatgccgatcac taacgaccagaagaagttgatgagcaacaatgtgcagatcgtgcgccaac

```
agtcctactcaatcatgtcaattatcaaggaggaagtgctcgcctatgtg gtgcaattgcctctgtacggagtcatcgacacacccctgctggaagctgca cactagcccactctgtacgaccaacaccaaggaaggttccaacatctgcc tgactaggaccgatcggggctggtattgcgataatgctgggtccgtgagc ttcttcccgcaagccgagacttgcaaagtgcagtcaaaccgcgtgttctg tgacaccatgaacagcctgaccctgccatccgaagtcaacctctgcaacg tggacatctttaacccgaaatacgactgcaagattatgacctccaagacc gacgtcagcagctctgtcatcactagcctgggagctattgtgtcctgcta cggaaagaccaaatgcactgcctcgaacaagaacagaggcatcatcaaga ccttcagcaacggctgtgactacgtgtccaacaagggagtggacaccgtg tccgtcgggaacaccctgtactacgtgaacaagcaggaggggaagtcgct ctacgtcaaggggaaccgattatcaatttctacgaccccctggtgttcc cttcctccgagttcgatgcctccatatcccaagtcaacgagaagatcaac cagtctcttgccttcatccggaagtcggacgaactgctgtccgccatcgg tggctatattccggaagcccccagggatggacaggcctacgtgcggaagg atggagaatgggtgcttttgtccaccttcctgggcggtctggtgccccgc ggctcacaccatcatcaccaccacggttcgtggtcccaccctcaatttga gaagtga
```

[Relevant components (bp coordinates): Signal sequence: 1-75; pep27: 328-408; F1: 409-1539; F2: 76-327; foldon: 1552-1632; Thrombin recognition sequence: 1639-1656; His-tag: 1657-1674; Streptag II: 1681-1704; Linker sequences: 1540-1551, 1633-1638, 1675-1680; P102A (naturally-occurring substitution): 304-306; I379V (naturally-occurring substitution): 1135-1137; M447V (naturally-occurring substitution): 1339-1341; S55C: 163-165; L188C: 562-564; D486S: 1456-1458]

SEQ ID NO:10: Nucleotide Sequence Nucleotide Sequence Encoding Pre-coursor Polypeptide of pXCS830:

atggaacttctgatcctgaaagccaacgcgattaccactatcctgactgc
cgtcaccttctgcttcgcatcgggacagaacattaccgaggagttctacc
agtccacctgttcggcggtgtccaagggttacctctcggccctgagaact
ggctggtaccactgtgtgattactatcgagctgagcaacatcaaggagaa
caagtgcaatggaacggacgcgaaggtcaagctgattaagcaggaactcg
ataagtacaagaacgccgtgaccgagctccagctgctgatgcaatcgacc
cctgccactaacaacagagctcgccgggaactgccgcgcttcatgaatta
caccctcaacaacgcgaagaaaaccaacgtgaccctgtccaagaagcgca
agcggaggttcctgggattcctgttgggcgtgggctccgcaatcgcatcc
ggagtggccgtgtccaaagtgctgcatctggaggggggaagtgaacaagat
caagtccgccctcctgtcaactaataaggcggtggtgtccctgagcaacg
gagtcagcgtgtgtacaatcaaggtcctggacctcaagaactacatcgac
aagcagctgttgcccatcgtcaacaagcagtcatgctcgattagcaatat
cgaaaccgtgattgagttccagcagaagaacaacagactgctcgaaatta
cccgggagttttccgtgaacgccggagtgaccactcctgtgtccacctac
atgcttacgaactccgaactgctcagcctcatcaacgatatgccgatcac
taacgaccagaagaagttgatgagcaacaatgtgcagatcgtgcgccaac
agtcctactcaatcatgtcaattatcaaggaggaagtgctcgcctatgtg
gtgcaattgcctctgtacggagtcatcgacacaccctgctggaagctgca
cactagcccactctgtacgaccaacaccaaggaaggttccaacatctgcc
tgactaggaccgatcggggctggtattgcgataatgctgggtccgtgagc
ttcttcccgcaagccgagacttgcaaagtgcagtcaaaccgcgtgttctg
tgacaccatgaacagcctgaccctgccatccgaagtcaacctctgcaacg
tggacatctttaacccgaaatacgactgcaagattatgacctccaagacc
gacgtcagcagctctgtcatcactagcctgggagctattgtgtcctgcta
cggaaagaccaaatgcactgcctcgaacaagaacagaggcatcatcaaga
ccttcagcaacggctgtgactacgtgtccaacaagggagtggacaccgtg
tccgtcgggaacaccctgtactacgtgaacaagcaggaggggaagtcgct
ctacgtcaaggggggaaccgattatcaatttctacgacccccctggtgttcc
cttccgacgagttcgatgcctccatatcccaagtcaacgagaagatcaac
cagtctcttgccttcatccggaagtcggacgaactgctgtccgccatcgg
tggctatattccggaagcccccagggatggacaggcctacgtgcggaagg
atggagaatgggtgcttttgtccaccttcctgggcggtctggtgccccgc
ggctcacaccatcatcaccaccacggttcgtggtcccaccctcaatttga
gaagtga

[Relevant components (bp coordinates): Signal sequence: 1-75; pep27: 328-408; F1: 409-1539; F2: 76-327; foldon: 1552-1632; Thrombin recognition sequence: 1639-1656; His-tag: 1657-1674; Streptag II: 1681-1704; Linker sequences: 1540-1551, 1633-1638, 1675-1680; P102A (naturally-occurring substitution): 304-306; I379V (naturally-occurring substitution): 1135-1137; M447V (naturally-occurring substitution): 1339-1341; T54H: 160-162; S55C: 163-165; L188C: 562-564; S190I: 568-570]

SEQ ID NO:11: Nucleotide Sequence Nucleotide Sequence Encoding Pre-coursor Polypeptide of pXCS847:

atggaacttctgatcctgaaagccaacgcgattaccactatcctgactgc
cgtcaccttctgcttcgcatcgggacagaacattaccgaggagttctacc
agtccacctgttcggcggtgtccaagggttacctctcggccctgagaact
ggctggtacaccagcgtgattactatcgagctgagcaacatcaaggagaa
caagtgcaatggaacggacgcgaaggtcaagctgattaagcaggaactcg
ataagtacaagaacgccgtgaccgagctccagctgctgatgcaatcgacc
cctgcctgtaacaacagagctcgccgggaactgccgcgcttcatgaatta
caccctcaacaacgcgaagaaaaccaacgtgaccctgtccaagaagcgca
agcggaggttcctgggattcctgttgggcgtgggctccgcatgtgcatcc
ggagtggccgtgtccaaagtgctgcatctggaggggggaagtgaacaagat
caagtccgccctcctgtcaactaataaggcggtggtgtccctgagcaacg
gagtcagcgtgctgacaatcaaggtcctggacctcaagaactacatcgac -continued aagcagctgttgcccatcgtcaacaagcagtcatgctcgattagcaatat cgaaaccgtgattgagttccagcagaagaacaacagactgctcgaatta cccgggagttttccgtgaacgccggagtgaccactcctgtgtccacctac atgcttacgaactccgaactgctcagcctcatcaacgatatgccgatcac taacgaccagaagaagttgatgagcaacaatgtgcagatcgtgcgccaac agtcctactcaatcatgtcaattatcaaggaggaagtgctcgcctatgtg gtgcaattgcctctgtacggagtcatcgacacaccctgctggaagctgca cactagcccactctgtacgaccaacaccaaggaaggttccaacatctgcc tgactaggaccgatcggggctggtattgcgataatgctgggtccgtgagc ttcttcccgcaagccgagacttgcaaagtgcagtcaaaccgcgtgttctg tgacaccatgaacagcctgaccctgccatccgaagtcaacctctgcaacg tggacatctttaacccgaaatacgactgcaagattatgacctccaagacc gacgtcagcagctctgtcatcactagcctgggagctattgtgtcctgcta cggaaagaccaaatgcactgcctcgaacaagaacagaggcatcatcaaga ccttcagcaacggctgtgactacgtgtccaacaagggagtggacaccgtg tccgtcgggaacaccctgtactacgtgaacaagcaggaggggaagtcgct ctacgtcaaggggggaaccgattatcaatttctacgaccccctggtgttcc cttcctccgagttcgatgcctccatatcccaagtcaacgagaagatcaac cagtctcttgccttcatccggaagtcggacgaactgctgtccgccatcgg tggctatattccggaagcccccagggatggacaggcctacgtgcggaagg atggagaatgggtgcttttgtccaccttcctgggcggtctggtgcccgc ggctcacaccatcatcaccaccacggttcgtggtcccaccctcaatttga gaagtga

[Relevant components (bp coordinates): Signal sequence: 1-75; pep27: 328-408; F1: 409-1539; F2: 76-327; foldon: 1552-1632; Thrombin recognition sequence: 1639-1656; His-tag: 1657-1674; Streptag II: 1681-1704; Linker sequences: 1540-1551, 1633-1638, 1675-1680; P102A (naturally-occurring substitution): 304-306; I379V (naturally-occurring substitution): 1135-1137; M447V (naturally-occurring substitution): 1339-1341; T103C: 307-309; I148C: 442-444; S190I: 568-570; D486S: 1456-1458]

SEQ ID NO:12: Nucleotide Sequence Nucleotide Sequence Encoding Pre-coursor Polypeptide of pXCS851:

atggaacttctgatcctgaaagccaacgcgattaccactatcctgactgc cgtcaccttctgcttcgcatcgggacagaacattaccgaggagttctacc agtccacctgttcggcggtgtccaagggttacctctcggccctgagaact ggctggtaccacagcgtgattactatcgagctgagcaacatcaaggagaa caagtgcaatggaacggacgcgaaggtcaagctgattaagcaggaactcg ataagtacaagaacgccgtgaccgagctccagctgctgatgcaatcgacc cctgcctgtaacaacagagctcgccgggaactgccgcgcttcatgaatta caccctcaacaacgcgaagaaaaccaacgtgaccctgtccaagaagcgca agcggaggttcctgggattcctgttgggcgtgggctccgcatgtgcatcc ggagtggccgtgtccaaagtgctgcatctggaggggggaagtgaacaagat -continued caagtccgccctcctgtcaactaataaggcggtggtgtccctgagcaacg gagtcagcgtgctgacaatcaaggtcctggacctcaagaactacatcgac aagcagctgttgcccatcgtcaacaagcagtcatgctcgattagcaatat cgaaaccgtgattgagttccagcagaagaacaacagactgctcgaatta cccgggagttttccgtgaacgccggagtgaccactcctgtgtccacctac atgcttacgaactccgaactgctcagcctcatcaacgatatgccgatcac taacgaccagaagaagttgatgagcaacaatgtgcagatcgtgcgccaac agtcctactcaatcatgtcaattatcaaggaggaaatcctcgcctatgtg gtgcaattgcctctgtacggagtcatcgacacaccctgctggaagctgca cactagcccactctgtacgaccaacaccaaggaaggttccaacatctgcc tgactaggaccgatcggggctggtattgcgataatgctgggtccgtgagc ttcttcccgcaagccgagacttgcaaagtgcagtcaaaccgcgtgttctg tgacaccatgaacagcctgaccctgccatccgaagtcaacctctgcaacg tggacatctttaacccgaaatacgactgcaagattatgacctccaagacc gacgtcagcagctctgtcatcactagcctgggagctattgtgtcctgcta cggaaagaccaaatgcactgcctcgaacaagaacagaggcatcatcaaga ccttcagcaacggctgtgactacgtgtccaacaagggagtggacaccgtg tccgtcgggaacaccctgtactacgtgaacaagcaggaggggaagtcgct ctacgtcaaggggggaaccgattatcaatttctacgaccccctggtgttcc cttcctccgagttcgatgcctccatatcccaagtcaacgagaagatcaac cagtctcttgccttcatccggaagtcggacgaactgctgtccgccatcgg tggctatattccggaagcccccagggatggacaggcctacgtgcggaagg atggagaatgggtgcttttgtccaccttcctgggcggtctggtgcccgc ggctcacaccatcatcaccaccacggttcgtggtcccaccctcaatttga gaagtga

[Relevant components (bp coordinates): Signal sequence: 1-75; pep27: 328-408; F1: 409-1539; F2: 76-327; foldon: 1552-1632; Thrombin recognition sequence: 1639-1656; His-tag: 1657-1674; Streptag II: 1681-1704; Linker sequences: 1540-1551, 1633-1638, 1675-1680; P102A (naturally-occurring substitution): 304-306; I379V (naturally-occurring substitution): 1135-1137; M447V (naturally-occurring substitution): 1339-1341; T54H: 160-162; T103C: 307-309; I148C: 442-444; S190I: 568-570; V296I: 886-888; D486S: 1456-1458]

SEQ ID NO:13: Nucleotide Sequence Nucleotide Sequence Encoding Pre-coursor Polypeptide of pXCS852:

atggaacttctgatcctgaaagccaacgcgattaccactatcctgactgc cgtcaccttctgcttcgcatcgggacagaacattaccgaggagttctacc agtccacctgttcggcggtgtccaagggttacctctcggccctgagaact ggctggtaccactgtgtgattactatcgagctgagcaacatcaaggagaa caagtgcaatggaacggacgcgaaggtcaagctgattaagcaggaactcg ataagtacaagaacgccgtgaccgagctccagctgctgatgcaatcgacc cctgccactaacaacagagctcgccgggaactgccgcgcttcatgaatta -continued caccctcaacaacgcgaagaaaaccaacgtgaccctgtccaagaagcgca agcggaggttcctgggattcctgttgggcgtgggctccgcaatcgcatcc ggagtggccgtgtccaaagtgctgcatctggagggggaagtgaacaagat caagtccgccctcctgtcaactaataaggcggtggtgtccctgagcaacg gagtcagcgtgtgtacatccaaggtcctggacctcaagaactacatcgac aagcagctgttgcccatcgtcaacaagcagtcatgctcgattagcaatat cgaaaccgtgattgagttccagcagaagaacaacagactgctcgaaatta cccgggagttttccgtgaacgccggagtgaccactcctgtgtccacctac atgcttacgaactccgaactgctcagcctcatcaacgatatgccgatcac taacgaccagaagaagttgatgagcaacaatgtgcagatcgtgcgccaac agtcctactcaatcatgtcaattatcaaggaggaagtgctcgcctatgtg gtgcaattgcctctgtacggagtcatcgacacaccctgctggaagctgca cactagcccactctgtacgaccaacaccaaggaaggttccaacatctgcc tgactaggaccgatcggggctggtattgcgataatgctgggtccgtgagc ttcttcccgcaagccgagacttgcaaagtgcagtcaaaccgcgtgttctg tgacaccatgaacagcctgaccctgccatccgaagtcaacctctgcaacg tggacatctttaacccgaaatacgactgcaagattatgacctccaagacc gacgtcagcagctctgtcatcactagcctgggagctattgtgtcctgcta cggaaagaccaaatgcactgcctcgaacaagaacagaggcatcatcaaga ccttcagcaacggctgtgactacgtgtccaacaagggagtggacaccgtg tccgtcgggaacaccctgtactacgtgaacaagcaggaggggaagtcgct ctacgtcaagggggaaccgattatcaatttctacgaccccctggtgttcc cttcctccgagttcgatgcctccatatcccaagtcaacgagaagatcaac cagtctcttgccttcatccggaagtcggacgaactgctgtccgccatcgg tggctatattccggaagcccccagggatggacaggcctacgtgcggaagg atggagaatgggtgcttttgtccaccttcctgggcggtctggtgccccgc ggctcacaccatcatcaccaccacggttcgtggtcccaccctcaatttga gaagtga

[Relevant components (bp coordinates): Signal sequence: 1-75; pep27: 328-408; F1: 409-1539 (only including native RSV F sequence); F2: 76-327; foldon: 1552-1632; Thrombin recognition sequence: 1639-1656; His-tag: 1657-1674; Streptag II: 1681-1704; Linker sequences: 1540-1551, 1633-1638, 1675-1680; P102A (naturally-occurring substitution): 304-306; I379V (naturally-occurring substitution): 1135-1137; M447V (naturally-occurring substitution): 1339-1341; T54H: 160-162; S55C: 163-165; L188C: 562-564; D486S: 1456-1458]

SEQ ID NO:14: Nucleotide Sequence Encoding Pre-cursor Polypeptide of pXCS853:

atggaacttctgatcctgaaagccaacgcgattaccactatcctgactgc cgtcaccttctgcttcgcatcgggacagaacattaccgaggagttctacc agtccacctgttcggcggtgtccaagggttacctctcggccctgagaact ggctggtacacctgtgtgattactatcgagctgagcaacatcaaggagaa -continued caagtgcaatggaacggacgcgaaggtcaagctgattaagcaggaactcg ataagtacaagaacgccgtgaccgagctccagctgctgatgcaatcgacc cctgccactaacaacagagctcgccgggaactgccgcgcttcatgaatta caccctcaacaacgcgaagaaaaccaacgtgaccctgtccaagaagcgca agcggaggttcctgggattcctgttgggcgtgggctccgcaatcgcatcc ggagtggccgtgtccaaagtgctgcatctggagggggaagtgaacaagat caagtccgccctcctgtcaactaataaggcggtggtgtccctgagcaacg gagtcagcgtgtgtacaatcaaggtcctggacctcaagaactacatcgac aagcagctgttgcccatcgtcaacaagcagtcatgctcgattagcaatat cgaaaccgtgattgagttccagcagaagaacaacagactgctcgaaatta cccgggagttttccgtgaacgccggagtgaccactcctgtgtccacctac atgcttacgaactccgaactgctcagcctcatcaacgatatgccgatcac taacgaccagaagaagttgatgagcaacaatgtgcagatcgtgcgccaac agtcctactcaatcatgtcaattatcaaggaggaagtgctcgcctatgtg gtgcaattgcctctgtacggagtcatcgacacaccctgctggaagctgca cactagcccactctgtacgaccaacaccaaggaaggttccaacatctgcc tgactaggaccgatcggggctggtattgcgataatgctgggtccgtgagc ttcttcccgcaagccgagacttgcaaagtgcagtcaaaccgcgtgttctg tgacaccatgaacagcctgaccctgccatccgaagtcaacctctgcaacg tggacatctttaacccgaaatacgactgcaagattatgacctccaagacc gacgtcagcagctctgtcatcactagcctgggagctattgtgtcctgcta cggaaagaccaaatgcactgcctcgaacaagaacagaggcatcatcaaga ccttcagcaacggctgtgactacgtgtccaacaagggagtggacaccgtg tccgtcgggaacaccctgtactacgtgaacaagcaggaggggaagtcgct ctacgtcaagggggaaccgattatcaatttctacgaccccctggtgttcc cttcctccgagttcgatgcctccatatcccaagtcaacgagaagatcaac cagtctcttgccttcatccggaagtcggacgaactgctgtccgccatcgg tggctatattccggaagcccccagggatggacaggcctacgtgcggaagg atggagaatgggtgcttttgtccaccttcctgggcggtctggtgccccgc ggctcacaccatcatcaccaccacggttcgtggtcccaccctcaatttga gaagtga

[Relevant components (bp coordinates): Signal sequence: 1-75; pep27: 328-408; F1: 409-1539; F2: 76-327; foldon: 1552-1632; Thrombin recognition sequence: 1639-1656; His-tag: 1657-1674; Streptag II: 1681-1704; Linker sequences: 1540-1551, 1633-1638, 1675-1680; P102A (naturally-occurring substitution): 304-306; I379V (naturally-occurring substitution): 1135-1137; M447V (naturally-occurring substitution): 1339-1341; S55C: 163-165; L188C: 562-564; S190I: 568-570; D486S: 1456-1458]

SEQ ID NO:15: Nucleotide Sequence Encoding Pre-cursor Polypeptide of pXCS855:

```
atggaacttctgatcctgaaagccaacgcgattaccactatcctgactgc
cgtcaccttctgcttcgcatcgggacagaacattaccgaggagttctacc
agtccacctgttcggcggtgtccaagggttacctctcggccctgagaact
ggctggtaccactgtgtgattactatcgagctgagcaacatcaaggagaa
caagtgcaatggaacggacgcgaaggtcaagctgattaagcaggaactcg
ataagtacaagaacgccgtgaccgagctccagctgctgatgcaatcgacc
cctgccactaacaacagagctcgccgggaactgccgcgcttcatgaatta
caccctcaacaacgcgaagaaaaccaacgtgaccctgtccaagaagcgca
agcggaggttcctgggattcctgttgggcgtgggctccgcaatcgcatcc
ggagtggccgtgtccaaagtgctgcatctggaggggaagtgaacaagat
caagtccgccctcctgtcaactaataaggcggtggtgtccctgagcaacg
gagtcagcgtgtgtacaatcaaggtcctggacctcaagaactacatcgac
aagcagctgttgcccatcgtcaacaagcagtcatgctcgattagcaatat
cgaaaccgtgattgagttccagcagaagaacaacagactgctcgaaatta
cccgggagttttccgtgaacgccggagtgaccactcctgtgtccacctac
atgcttacgaactccgaactgctcagcctcatcaacgatatgccgatcac
taacgaccagaagaagttgatgagcaacaatgtgcagatcgtgcgccaac
agtcctactcaatcatgtcaattatcaaggaggaagtgctcgcctatgtg
gtgcaattgcctctgtacggagtcatcgacacaccctgctggaagctgca
cactagcccactctgtacgaccaacaccaaggaaggttccaacatctgcc
tgactaggaccgatcggggctggtattgcgataatgctgggtccgtgagc
ttcttcccgcaagccgagacttgcaaagtgcagtcaaaccgcgtgttctg
tgacaccatgaacagcctgaccctgccatccgaagtcaacctctgcaacg
tggacatctttaacccgaaatacgactgcaagattatgacctccaagacc
gacgtcagcagctctgtcatcactagcctgggagctattgtgtcctgcta
cggaaagaccaaatgcactgcctcgaacaagaacagaggcatcatcaaga
ccttcagcaacggctgtgactacgtgtccaacaagggagtggacaccgtg
tccgtcgggaacaccctgtactacgtgaacaagcaggaggggaagtcgct
ctacgtcaaggggaaccgattatcaatttctacgaccccctggtgttcc
cttcctccgagttcgatgcctccatatcccaagtcaacgagaagatcaac
cagtctcttgccttcatccggaagtcggacgaactgctgtccgccatcgg
tggctatattccggaagcccccagggatggacaggcctacgtgcggaagg
atggagaatgggtgcttttgtccaccttcctgggcggtctggtgccccgc
ggctcacaccatcatcaccaccacggttcgtggtcccaccctcaatttga
gaagtga
```

[Relevant features (bp coordinates): Signal sequence: 1-75; pep27: 328-408; F1: 409-1539; F2: 76-327; foldon: 1552-1632; Thrombin recognition sequence: 1639-1656; His-tag: 1657-1674; Streptag II: 1681-1704; Linker sequences: 1540-1551, 1633-1638, 1675-1680; P102A (naturally-occurring substitution): 304-306; I379V (naturally-occurring substitution): 1135-1137; M447V (naturally-occurring substitution): 1339-1341; T54H: 160-162; S55C: 163-165; L188C: 562-564; S190I: 568-570; D486S: 1456-1458]

SEQ ID NO:16: Nucleotide Sequence Encoding Precursor Polypeptide of pXCS874:

```
atggaacttctgatcctgaaagccaacgcgattaccactatcctgactgc
cgtcaccttctgcttcgcatcgggacagaacattaccgaggagttctacc
agtccacctgttcggcggtgtccaagggttacctctcggccctgagaact
ggctggtacaccagcgtgattactatcgagctgagcaacatcaaggagaa
caagtgcaatggaacggacgcgaaggtcaagctgattaagcaggaactcg
ataagtacaagaacgccgtgaccgagctccagctgctgatgcaatcgacc
cctgccactaacaacagagctcgccgggaactgccgcgcttcatgaatta
caccctcaacaacgcgaagaaaaccaacgtgaccctgtccaagaagcgca
agcggaggttcctgggattcctgttgggcgtgggctccgcaatcgcatcc
ggagtggccgtgtaaagtgctgcatctggaggggaagtgaacaagat
caagtccgccctcctgtcaactaataaggcggtggtgtccctgagcaacg
gagtcagcgtgctgacaatcaaggtcctggacctcaagaactacatcgac
aagcagctgttgcccatcgtcaacaagcagtcatgctcgattagcaatat
cgaaaccgtgattgagttccagcagaagaacaacagactgctcgaaatta
cccgggagttttccgtgaacgccggagtgaccactcctgtgtccacctac
atgcttacgaactccgaactgctcagcctcatcaacgatatgccgatcac
taacgaccagaagaagttgatgagcaacaatgtgcagatcgtgcgccaac
agtcctactcaatcatgtgcattatcaaggaggaagtgctcgcctatgtg
gtgcaattgcctctgtacggagtcatcgacacaccctgctggaagctgca
cactagcccactctgtacgaccaacaccaaggaaggttccaacatctgcc
tgactaggaccgatcggggctggtattgcgataatgctgggtccgtgagc
ttcttcccgcaagccgagacttgcaaagtgcagtcaaaccgcgtgttctg
tgacaccatgaacagcctgaccctgccatccgaagtcaacctctgcaacg
tggacatctttaacccgaaatacgactgcaagattatgacctccaagacc
gacgtcagcagctctgtcatcactagcctgggagctattgtgtcctgcta
cggaaagaccaaatgcactgcctcgaacaagaacagaggcatcatcaaga
ccttcagcaacggctgtgactacgtgtccaacaagggagtggacaccgtg
tccgtcgggaacaccctgtactacgtgaacaagcaggaggggaagtcgct
ctacgtcaaggggaaccgattatcaatttctacgaccccctggtgttcc
cttcctccgagttcgatgcctccatatcccaagtcaacgagaagatcaac
cagtctcttgccttcatccggaagtcggacgaactgctgtccgccatcgg
tggctatattccggaagcccccagggatggacaggcctacgtgcggaagg
atggagaatgggtgcttttgtccaccttcctgggcggtctggtgccccgc
ggctcacaccatcatcaccaccacggttcgtggtcccaccctcaatttga
gaagtga
```

[Relevant features (bp coordinates): Signal sequence: 1-75; pep27: 328-408; F1: 409-1539; F2: 76-327; foldon: 1552-1632; Thrombin recognition sequence: 1639-1656; His-tag: 1657-1674; Streptag II: 1681-1704; Linker sequences: 1540-1551, 1633-1638, 1675-1680; P102A (naturally-occurring substitution): 304-306; I379V (naturally-occurring substitution): 1135-1137; M447V (naturally-occurring substitution): 1339-1341; S155C: 463-465; S190I: 568-570; S290C: 868-870; D486S: 1456-1458]

SEQ ID NO:17: Nucleotide Sequence Encoding Precursor Polypeptide of pXCS881:

atggaacttctgatcctgaaagccaacgcgattaccactatcctgactgc
cgtcaccttctgcttcgcatcgggacagaacattaccgaggagttctacc
agtccacctgttcggcggtgtccaagggttacctctcggccctgagaact
ggctggtaccactgtgtgattactatcgagctgagcaacatcaaggagaa
caagtgcaatggaacggacgcgaaggtcaagctgattaagcaggaactcg
ataagtacaagaacgccgtgaccgagctccagctgctgatgcaatcgacc
cctgccactaacaacagagctcgccgggaactgccgcgcttcatgaatta
caccctcaacaacgcgaagaaaaccaacgtgaccctgtccaagaagcgca
agcggaggttcctgggattcctgtgtggcgtgggctccgcaatcgcatcc
ggagtggccgtgtccaaagtgctgcatctggaggggaagtgaacaagat
caagtccgccctcctgtcaactaataaggcggtggtgtccctgagcaacg
gagtcagcgtgtgtacatccaaggtcctggacctcaagaactacatcgac
aagcagctgttgcccatcgtcaacaagcagtcatgctcgattagcaatat
cgaaaccgtgattgagttccagcagaagaacaacagactgctcgaaatta
cccgggagttttccgtgaacgccggagtgaccactcctgtgtccacctac
atgcttacgaactccgaactgctcagcctcatcaacgatatgccgatcac
taacgaccagaagaagttgatgagcaacaatgtgcagatcgtgcgccaac
agtcctactcaatcatgtcaattatcaaggaggaaatcctcgcctatgtg
gtgcaattgcctctgtacggagtcatcgacacaccctgctggaagctgca
cactagcccactctgtacgaccaacaccaaggaaggttccaacatctgcc
tgactaggaccgatcggggctggtattgcgataatgctgggtccgtgagc
ttcttcccgcaagccgagacttgcaaagtgcagtcaaaccgcgtgttctg
tgacaccatgtgtagcctgaccctgccatccgaagtcaacctctgcaacg
tggacatctttaacccgaaatacgactgcaagattatgacctccaagacc
gacgtcagcagctctgtcatcactagcctgggagctattgtgtcctgcta
cggaaagaccaaatgcactgcctcgaacaagaacagaggcatcatcaaga
ccttcagcaacggctgtgactacgtgtccaacaagggagtggacaccgtg
tccgtcgggaacaccctgtactacgtgaacaagcaggaggggaagtcgct
ctacgtcaaggggaaccgattatcaatttctacgaccccctggtgttcc
cttccagccagttcagtgcctccatatcccaagtcaacgagaagatcaac
cagtctcttgccttcatccggaagtcggacgaactgctgtccgccatcgg
tggctatattccggaagcccccagggatggacaggcctacgtgcggaagg
atggagaatgggtgcttttgtccaccttcctgggcggtctggtgccccgc
ggctcacaccatcatcaccaccacggttcgtggtcccaccctcaatttga
gaagtga

[Relevant features (bp coordinates): Signal sequence: 1-75; pep27: 328-408; F1: 409-1539; F2: 76-327; foldon: 1552-1632; Thrombin recognition sequence: 1639-1656; His-tag: 1657-1674; Streptag II: 1681-1704; Linker sequences: 1540-1551, 1633-1638, 1675-1680; P102A (naturally-occurring substitution): 304-306; I379V (naturally-occurring substitution): 1135-1137; M447V (naturally-occurring substitution): 1339-1341; T54H: 160-162; S55C: 163-165; L142C: 424-426; L188C: 562-564; V296I: 886-888; N371C: 1111-1113; D486S: 1456-1458; E487Q: 1459-1461; D489S: 1465-1467]

SEQ ID NO:18: Nucleotide Sequence Encoding Precursor Polypeptide of pXCS898:

atggaacttctgatcctgaaagccaacgcgattaccactatcctgactgc
cgtcaccttctgcttcgcatcgggacagaacattaccgaggagttctacc
agtccacctgttcggcggtgtccaagggttacctctcggccctgagaact
ggctggtaccacagcgtgattactatcgagctgagcaacatcaaggagaa
caagtgcaatggaacggacgcgaaggtcaagctgattaagcaggaactcg
ataagtacaagaacgccgtgaccgagctccagctgctgatgcaatcgacc
cctgccactaacaacagagctcgccgggaactgccgcgcttcatgaatta
caccctcaacaacgcgaagaaaaccaacgtgaccctgtccaagaagcgca
agcggaggttcctgggattcctgttgggcgtgggctccgcaatcgcatcc
ggagtggccgtgtgtaaagtgctgcatctggaggggaagtgaacaagat
caagtccgccctcctgtcaactaataaggcggtggtgtccctgagcaacg
gagtcagcgtgctgacaatcaaggtcctggacctcaagaactacatcgac
aagcagctgttgcccatcgtcaacaagcagtcatgctcgattagcaatat
cgaaaccgtgattgagttccagcagaagaacaacagactgctcgaaatta
cccgggagttttccgtgaacgccggagtgaccactcctgtgtccacctac
atgcttacgaactccgaactgctcagcctcatcaacgatatgccgatcac
taacgaccagaagaagttgatgagcaacaatgtgcagatcgtgcgccaac
agtcctactcaatcatgtcattatcaaggaggaaatcctcgcctatgtg
gtgcaattgcctctgtacggagtcatcgacacaccctgctggaagctgca
cactagcccactctgtacgaccaacaccaaggaaggttccaacatctgcc
tgactaggaccgatcggggctggtattgcgataatgctgggtccgtgagc
ttcttcccgcaagccgagacttgcaaagtgcagtcaaaccgcgtgttctg
tgacaccatgaacagcctgaccctgccatccgaagtcaacctctgcaacg
tggacatctttaacccgaaatacgactgcaagattatgacctccaagacc
gacgtcagcagctctgtcatcactagcctgggagctattgtgtcctgcta
cggaaagaccaaatgcactgcctcgaacaagaacagaggcatcatcaaga
ccttcagcaacggctgtgactacgtgtccaacaagggagtggacaccgtg
tccgtcgggaacaccctgtactacgtgaacaagcaggaggggaagtcgct
ctacgtcaaggggaaccgattatcaatttctacgaccccctggtgttcc
cttccgacgagttcgatgcctccatatcccaagtcaacgagaagatcaac
cagtctcttgccttcatccggaagtcggacgaactgctgtccgccatcgg -continued

```
tggctatattccggaagcccccagggatggacaggcctacgtgcggaagg atggagaatgggtgcttttgtccaccttcctgggcggtctggtgccccgc ggctcacaccatcatcaccaccacggttcgtggtcccaccctcaatttga gaagtga
```

[Relevant features (bp coordinates): Signal sequence: 1-75; pep27: 328-408; F1: 409-1539; F2: 76-327; foldon: 1552-1632; Thrombin recognition sequence: 1639-1656; His-tag: 1657-1674; Streptag II: 1681-1704; Linker sequences: 1540-1551, 1633-1638, 1675-1680; P102A (naturally-occurring substitution): 304-306; I379V (naturally-occurring substitution): 1135-1137; M447V (naturally-occurring substitution): 1339-1341; T54H: 160-162; S155C: 463-465; S190I: 568-570; S290C: 868-870; V296I: 886-888]

SEQ ID NO:19: Amino Acid Sequence of Precursor Polypeptide of pXCS847:

MELLILKANAITTILTAVTFCFASGQNITEEFYQSTCSAVSKGYLSALRT

GWYTSVITIELSNIKENKCNGTDAKVKLIKQELDKYKNAVTELQLLMQST

PACNNRARRELPRFMNYTLNNAKKTNVTLSKKRKRRFLGFLLGVGSACAS

GVAVSKVLHLEGEVNKIKSALLSTNKAVVSLSNGVSVLTIKVLDLKNYID

KQLLPIVNKQSCSISNIETVIEFQQKNNRLLEITREFSVNAGVTTPVSTY

MLTNSELLSLINDMPITNDQKKLMSNNVQIVRQQSYSIMSIIKEEVLAYV

VQLPLYGVIDTPCWKLHTSPLCTTNTKEGSNICLTRTDRGWYCDNAGSVS

FFPQAETCKVQSNRVFCDTMNSLTLPSEVNLCNVDIFNPKYDCKIMTSKT

DVSSSVITSLGAIVSCYGKTKCTASNKNRGIIKTFSNGCDYVSNKGVDTV

SVGNTLYYVNKQEGKSLYVKGEPIINFYDPLVFPSSEFDASISQVNEKIN

QSLAFIRKSDELLSAIGGYIPEAPRDGQAYVRKDGEWVLLSTFLGGLVPR

GSHHHHHHGSWSHPQFEK

[Relevant features (amino acid residue coordinates): Signal sequence (not present in final product): 1-25; pep27 (not present in final product): 110-136; F1: 137-513; F2: 26-109; foldon: 518-544; Thrombin recognition sequence: 547-552; His-tag: 553-558; Streptag II: 561-568; P102A (naturally-occurring substitution); I379V (naturally-occurring substitution); M447V (naturally-occurring substitution); T103C, I148C; S190I; D486S]

SEQ ID NO:20: Amino Acid Sequence of Precursor Polypeptide of pXCS851:

MELLILKANAITTILTAVTFCFASGQNITEEFYQSTCSAVSKGYLSALRT

GWYHSVITIELSNIKENKCNGTDAKVKLIKQELDKYKNAVTELQLLMQST

PACNNRARRELPRFMNYTLNNAKKTNVTLSKKRKRRFLGFLLGVGSACAS

GVAVSKVLHLEGEVNKIKSALLSTNKAWSLSNGVSVLTIKVLDLKNYIDK

QLLPIVNKQSCSISNIETVIEFQQKNNRLLEITREFSVNAGVTTPVSTYM

LTNSELLSLINDMPITNDQKKLMSNNVQIVRQQSYSIMSIIKEEILAYVV

QLPLYGVIDTPCWKLHTSPLCTTNTKEGSNICLTRTDRGWYCDNAGSVSF

FPQAETCKVQSNRVFCDTMNSLTLPSEVNLCNVDIFNPKYDCKIMTSKTD

VSSSVITSLGAIVSCYGKTKCTASNKNRGIIKTFSNGCDYVSNKGVDTVS

VGNTLYYVNKQEGKSLYVKGEPIINFYDPLVFPSSEFDASISQVNEKINQ

SLAFIRKSDELLSAIGGYIPEAPRDGQAYVRKDGEWVLLSTFLGGLVPRG

SHHHHHHGSWSHPQFEK

[Relevant features (amino acid residue coordinates): Signal sequence (not present in final product): 1-25; pep27 (not present in final product): 110-136; F1: 137-513; F2: 26-109; foldon: 518-544; Thrombin recognition sequence: 547-552; His-tag: 553-558; Streptag II: 561-568; P102A (naturally-occurring substitution); I379V (naturally-occurring substitution); M447V (naturally-occurring substitution); T54H; T103C, I148C; S190I, V296I; D486S]

SEQ ID NO:21: Amino Acid Sequence of Precursor Polypeptide of pXCS852:

MELLILKANAITTILTAVTFCFASGQNITEEFYQSTCSAVSKGYLSALRT

GWYHCVITIELSNIKENKCNGTDAKVKLIKQELDKYKNAVTELQLLMQST

PATNNRARRELPRFMNYTLNNAKKTNVTLSKKRKRRFLGFLLGVGSAIAS

GVAVSKVLHLEGEVNKIKSALLSTNKAVVSLSNGVSVCTSKVLDLKNYID

KQLLPIVNKQSCSISNIETVIEFQQKNNRLLEITREFSVNAGVTTPVSTY

MLTNSELLSLINDMPITNDQKKLMSNNVQIVRQQSYSIMSIIKEEVLAYV

VQLPLYGVIDTPCWKLHTSPLCTTNTKEGSNICLTRTDRGWYCDNAGSVS

FFPQAETCKVQSNRVFCDTMNSLTLPSEVNLCNVDIFNPKYDCKIMTSKT

DVSSSVITSLGAIVSCYGKTKCTASNKNRGIIKTFSNGCDYVSNKGVDTV

SVGNTLYYVNKQEGKSLYVKGEPIINFYDPLVFPSSEFDASISQVNEKIN

QSLAFIRKSDELLSAIGGYIPEAPRDGQAYVRKDGEWVLLSTFLGGLVPR

GSHHHHHHGSWSHPQFEK

[Relevant features (amino acid residue coordinates): Signal sequence (not present in final product): 1-25; pep27 (not present in final product): 110-136; F1: 137-513 (only including native RSV F sequence); F2: 26-109; foldon: 518-544; Thrombin recognition sequence: 547-552; His-tag: 553-558; Streptag II: 561-568; P102A (naturally-occurring substitution); I379V (naturally-occurring substitution); M447V (naturally-occurring substitution); T54H (introduced mutation); S55C (introduced mutation); L188C (introduced mutation); D486S (introduced mutation)]

SEQ ID NO:22: Amino Acid Sequence of Heavy Chain Variable Domain of Antibody D25:

QVQLVQSGAEVKKPGSSVMVSCQASGGPLRNYIINWLRQAPGQGPEWMGG

IIPVLGTVHYAPKFQGRVTITADESTDTAYIHLISLRSEDTAMYYCATET

ALVVSTTYLPHYFDNWGQGTLVTVSS

SEQ ID NO:23: Amino Acid Sequence of Light Chain Variable Domain of Antibody D25:

DIQMTQSPSSLSAAVGDRVTITCQASQDIVNYLNWYQQKPGKAPKLLIYV

ASNLETGVPSRFSGSGSGTDFSLTISSLQPEDVATYYCQQYDNLPLTFGG

GTKVEIKR

SEQ ID NO:24: Amino Acid Sequence of Heavy Chain Variable Domain of Antibody AM14:

EVQLVESGGGWQPGRSLRLSCAASGFSFSHYAMHWVRQAPGKGLEWVAVI

SYDGENTYYADSVKGRFSISRDNSKNTVSLQMNSLRPEDTALYYCARDRI

VDDYYYYGMDVWGQGATVTVSS

SEQ ID NO:25: Amino Acid Sequence of Light Chain Variable Domain of Antibody AM14:

DIQMTQSPSSLSASVGDRVTITCQASQDIKKYLNWYHQKPGKVPELLMHD

ASNLETGVPSRFSGRGSGTDFTLTISSLQPEDIGTYYCQQYDNLPPLTFG

GGTKVEIKRTV

SEQ ID NO:26: Amino Acid Sequence of Heavy Chain Variable Domain of Antibody AM22

QVQLVQSGAEVKKPGATVKVSCKISGHTLIKLSIHWVRQAPGKGLEWMGG

YEGEVDEIFYAQKFQHRLTVIADTATDTVYMELGRLTSDDTAVYFCGTLG

VTVTEAGLGIDDYWGQGTLVTVSS

SEQ ID NO:27: Amino Acid Sequence of Light Chain Variable Domain of Antibody AM22

EIVLTQSPGTLSLSPGERATLSCRASQIVSRNHLAWYQQKPGQAPRLLIF

GASSRATGIPVRFSGSGSGTDFTLTINGLAPEDFAVYYCLSSDSSIFTFG

PGTKVDFK

SEQ ID NO:28: Amino Acid Sequence of Heavy Chain Variable Domain of Antibody MPE8:

EVQLVESGGGLVKPGGSLRLSCAASGFTFSSYSMNWVRQAPGKGLEWVSS

ISASSSYSDYADSAKGRFTISRDNAKTSLFLQMNSLRAEDTAIYFCARAR

ATGYSSITPYFDIWGQGTLVTVSS

SEQ ID NO:29: Amino Acid Sequence of Light Chain Variable Domain of Antibody MPE8:

QSVVTQTPSVSGAPGQRVTISCTGSSSNIGAGYDVHWYQQLPGTAPKLLI

YDNNNRPSGVPDRFSASKSGTSASLAITGLQAEDEADYYCQSYDRNLSGV

FGTGTKVTVL

SEQ ID NO:30: Amino Acid Sequence of Heavy Chain Variable Domain of Antibody 101F:

QVTLKESGPGILQPSQTLSLTCSFSGFSLSTSGMGVSWIRQPSGKGLEWL

AHIYWDDDKRYNPSLKSRLTISKDTSRNQVFLKITSVDTADTATYYCARL

YGFTYGFAYWGQGTLVTVSA

SEQ ID NO:31: Amino Acid Sequence of Light Chain Variable Domain of Antibody 101F:

DIVLTQSPASLAVSLGQRATIFCRASQSVDYNGISYMHWFQQKPGQPPKL

LIYAASNPESGIPARFTGSGSGTDFTLNIHPVEEEDAATYYCQQIIEDPW

TFGGGTKLEIK

SEQ ID NO: 32: Amino Acid Sequence of Precursor Polypeptide of pXCS738:

MELLILKANAITTILTAVTFCFASGQNITEEFYQSTCSAVSKGYLSALRT

GWYHCVITIELSNIKENKCNGTDAKVKLIKQELDKYKNAVTELQLLMQST

PATNNRARRELPRFMNYTLNNAKKTNVTLSKKRKRRFLGFLCGVGSAIAS

GVAVSKVLHLEGEVNKIKSALLSTNKAVVSLSNGVSVCTSKVLDLKNYID

KQLLPIVNKQSCSISNIETVIEFQQKNNRLLEITREFSVNAGVTTPVSTY

MLTNSELLSLINDMPITNDQKKLMSNNVQIVRQQSYSIMSIIKEEILAYV

VQLPLYGVIDTPCWKLHTSPLCTTNTKEGSNICLTRTDRGWYCDNAGSVS

FFPQAETCKVQSNRVFCDTMCSLTLPSEVNLCNVDIFNPKYDCKIMTSKT

DVSSSVITSLGAIVSCYGKTKCTASNKNRGIIKTFSNGCDYVSNKGVDTV

SVGNTLYYVNKQEGKSLYVKGEPIINFYDPLVFPSDEFDASISQVNEKIN

QSLAFIRKSDELLSAIGGYIPEAPRDGQAYVRKDGEWVLLSTFLGGLVPR

GSHHHHHHGSWSHPQFEK

[Relevant features (amino acid residue coordinates): Signal sequence (not present in final product): 1-25; pep27 (not present in final product): 110-136; F1: 137; F2: 26-109; foldon: 518-544; Thrombin recognition sequence: 547-552; His-tag: 553-558; Streptag II: 561-568; Linker sequences: 514-517, 545-546, 559-560; P102A (naturally-occurring substitution); I379V (naturally-occurring substitution); M447V (naturally-occurring substitution); T54H (introduced mutation); S55C (introduced mutation); L142C (introduced mutation); L188C (introduced mutation); V296I (introduced mutation); N371C (introduced mutation)]

SEQ ID NO:33: Amino Acid Sequence of Precursor Polypeptide of pXCS780:

MELLILKANAITTILTAVTFCFASGQNITEEFYQSTCSAVSKGYLSALRT

GWYTCVITIELSNIKENKCNGTDAKVKLIKQELDKYKNAVTELQLLMQST

PATNNRARRELPRFMNYTLNNAKKTNVTLSKKRKRRFLGFLLGVGSAIAS

GVAVSKVLHLEGEVNKIKSALLSTNKAVVSLSNGVSVCTSKVLDLKNYID

KQLLPIVNKQSCSISNIETVIEFQQKNNRLLEITREFSVNAGVTTPVSTY

MLTNSELLSLINDMPITNDQKKLMSNNVQIVRQQSYSIMSIIKEEVLAYW

QLPLYGVIDTPCWKLHTSPLCTTNTKEGSNICLTRTDRGWYCDNAGSVSF

FPQAETCKVQSNRVFCDTMNSLTLPSEVNLCNVDIFNPKYDCKIMTSKTD

VSSSVITSLGAIVSCYGKTKCTASNKNRGIIKTFSNGCDYVSNKGVDTVS

VGNTLYYVNKQEGKSLYVKGEPIINFYDPLVFPSSEFDASISQVNEKINQ

SLAFIRKSDELLSAIGGYIPEAPRDGQAYVRKDGEWVLLSTFLGGLVPRG

SHHHHHHGSWSHPQFEK

[Relevant features (amino acid residue coordinates): Signal sequence (not present in final product): 1-25; pep27 (not present in final product): 110-136; F1: 137-513; F2: 26-109; foldon: 518-544; Thrombin recognition sequence: 547-552; His-tag: 553-558; Streptag II: 561-568; Linker sequences: 514-517, 545-546, 559-560; P102A (naturally-occurring substitution); I379V (naturally-occurring substitution); M447V (naturally-occurring substitution); S55C (introduced mutation); L188C (introduced mutation); D486S (introduced mutation)]

SEQ ID NO: 34: Amino Acid Sequence of Precursor Polypeptide of pXCS830:

MELLILKANAITTILTAVTFCFASGQNITEEFYQSTCSAVSKGYLSALRT
GWYHCVITIELSNIKENKCNGTDAKVKLIKQELDKYKNAVTELQLLMQST
PATNNRARRELPRFMNYTLNNAKKTNVTLSKKRKRRFLGFLLGVGSAIAS
GVAVSKVLHLEGEVNKIKSALLSTNKAVVSLSNGVSVCTIKVLDLKNYID
KQLLPIVNKQSCSISNIETVIEFQQKNNRLLEITREFSVNAGVTTPVSTY
MLTNSELLSLINDMPITNDQKKLMSNNVQIVRQQSYSIMSIIKEEVLAYV
VQLPLYGVIDTPCWKLHTSPLCTTNTKEGSNICLTRTDRGWYCDNAGSVS
FFPQAETCKVQSNRVFCDTMNSLTLPSEVNLCNVDIFNPKYDCKIMTSKT
DVSSSVITSLGAIVSCYGKTKCTASNKNRGIIKTFSNGCDYVSNKGVDTV
SVGNTLYYVNKQEGKSLYVKGEPIINFYDPLVFPSDEFDASISQVNEKIN
QSLAFIRKSDELLSAIGGYIPEAPRDGQAYVRKDGEWVLLSTFLGGLVPR
GSHHHHHHGSWSHPQFEK

[Relevant features (amino acid residue coordinates): Signal sequence (not present in final product): 1-25; pep27 (not present in final product): 110-136; F1: 137-513; F2: 26-109; foldon: 518-544; Thrombin recognition sequence: 547-552; His-tag: 553-558; Streptag II: 561-568; Linker sequences: 514-517, 545-546, 559-560; P102A (naturally-occurring substitution); I379V (naturally-occurring substitution); M447V (naturally-occurring substitution); T54H (introduced mutation); S55C (introduced mutation); L188C (introduced mutation); S190I (introduced mutation)]

SEQ ID NO:35: Amino Acid Sequence of Precursor Polypeptide of pXCS853:

MELLILKANAITTILTAVTFCFASGQNITEEFYQSTCSAVSKGYLSALRT
GWYTCVITIELSNIKENKCNGTDAKVKLIKQELDKYKNAVTELQLLMQST
PATNNRARRELPRFMNYTLNNAKKTNVTLSKKRKRRFLGFLLGVGSAIAS
GVAVSKVLHLEGEVNKIKSALLSTNKAVVSLSNGVSVCTIKVLDLKNYID
KQLLPIVNKQSCSISNIETVIEFQQKNNRLLEITREFSVNAGVTTPVSTY
MLTNSELLSLINDMPITNDQKKLMSNNVQIVRQQSYSIMSIIKEEVLAYV
VQLPLYGVIDTPCWKLHTSPLCTTNTKEGSNICLTRTDRGWYCDNAGSVS
FFPQAETCKVQSNRVFCDTMNSLTLPSEVNLCNVDIFNPKYDCKIMTSKT
DVSSSVITSLGAIVSCYGKTKCTASNKNRGIIKTFSNGCDYVSNKGVDTV
SVGNTLYYVNKQEGKSLYVKGEPIINFYDPLVFPSSEFDASISQVNEKIN
QSLAFIRKSDELLSAIGGYIPEAPRDGQAYVRKDGEWVLLSTFLGGLVPR
GSHHHHHHGSWSHPQFEK

[Relevant features (amino acid residue coordinates): Signal sequence (not present in final product): 1-25; pep27 (not present in final product): 110-136; F1: 137-513; F2: 26-109; foldon: 518-544; Thrombin recognition sequence: 547-552; His-tag: 553-558; Streptag II: 561-568; Linker sequences: 514-517, 545-546, 559-560; P102A (naturally-occurring substitution); I379V (naturally-occurring substitution); M447V (naturally-occurring substitution); S55C (introduced mutation); L188C (introduced mutation); S190I (introduced mutation); D486S (introduced mutation)]

SEQ ID NO:36: Amino Acid Sequence of Precursor Polypeptide of pXCS855:

MELLILKANAITTILTAVTFCFASGQNITEEFYQSTCSAVSKGYLSALRT
GWYHCVITIELSNIKENKCNGTDAKVKLIKQELDKYKNAVTELQLLMQST
PATNNRARRELPRFMNYTLNNAKKTNVTLSKKRKRRFLGFLLGVGSAIAS
GVAVSKVLHLEGEVNKIKSALLSTNKAVVSLSNGVSVCTIKVLDLKNYID
KQLLPIVNKQSCSISNIETVIEFQQKNNRLLEITREFSVNAGVTTPVSTY
MLTNSELLSLINDMPITNDQKKLMSNNVQIVRQQSYSIMSIIKEEVLAYV
VQLPLYGVIDTPCWKLHTSPLCTTNTKEGSNICLTRTDRGWYCDNAGSVS
FFPQAETCKVQSNRVFCDTMNSLTLPSEVNLCNVDIFNPKYDCKIMTSKT
DVSSSVITSLGAIVSCYGKTKCTASNKNRGIIKTFSNGCDYVSNKGVDTV
SVGNTLYYVNKQEGKSLYVKGEPIINFYDPLVFPSSEFDASISQVNEKIN
QSLAFIRKSDELLSAIGGYIPEAPRDGQAYVRKDGEWVLLSTFLGGLVPR
GSHHHHHHGSWSHPQFEK

[Relevant features (amino acid residue coordinates): Signal sequence (not present in final product): 1-25; pep27 (not present in final product): 110-136; F1: 137-513; F2: 26-109; foldon: 518-544; Thrombin recognition sequence: 547-552; His-tag: 553-558; Streptag II: 561-568; Linker sequences: 514-517, 545-546, 559-560; P102A (naturally-occurring substitution); I379V (naturally-occurring substitution); M447V (naturally-occurring substitution); T54H (introduced mutation); S55C (introduced mutation); L188C (introduced mutation); S190I (introduced mutation); D486S (introduced mutation)]

SEQ ID NO: 37: Amino Acid Sequence of Precursor Polypeptide of pXCS874:

MELLILKANAITTILTAVTFCFASGQNITEEFYQSTCSAVSKGYLSALRT
GWYTSVITIELSNIKENKCNGTDAKVKLIKQELDKYKNAVTELQLLMQST
PATNNRARRELPRFMNYTLNNAKKTNVTLSKKRKRRFLGFLLGVGSAIAS
GVAVCKVLHLEGEVNKIKSALLSTNKAVVSLSNGVSVLTIKVLDLKNYID
KQLLPIVNKQSCSISNIETVIEFQQKNNRLLEITREFSVNAGVTTPVSTY
MLTNSELLSLINDMPITNDQKKLMSNNVQIVRQQSYSIMCIIKEEVLAYV
VQLPLYGVIDTPCWKLHTSPLCTTNTKEGSNICLTRTDRGWYCDNAGSVS
FFPQAETCKVQSNRVFCDTMNSLTLPSEVNLCNVDIFNPKYDCKIMTSKT
DVSSSVITSLGAIVSCYGKTKCTASNKNRGIIKTFSNGCDYVSNKGVDTV
SVGNTLYYVNKQEGKSLYVKGEPIINFYDPLVFPSSEFDASISQVNEKIN
QSLAFIRKSDELLSAIGGYIPEAPRDGQAYVRKDGEWVLLSTFLGGLVPR
GSHHHHHHGSWSHPQFEK

[Relevant features (amino acid residue coordinates): Signal sequence (not present in final product): 1-25; pep27 (not present in final product): 110-136; F1: 137-513; F2: 26-109;

foldon: 518-544; Thrombin recognition sequence: 547-552; His-tag: 553-558; Streptag II: 561-568; Linker sequences: 514-517, 545-546, 559-560; P102A (naturally-occurring substitution); I379V (naturally-occurring substitution); M447V (naturally-occurring substitution); S155C (introduced mutation); S190I (introduced mutation); S290C (introduced mutation); D486S (introduced mutation)]

SEQ ID NO:38: Amino Acid Sequence of Precursor Polypeptide of pXCS881:

MELLILKANAITTILTAVTFCFASGQNITEEFYQSTCSAVSKGYLSALRT
GWYHCVITIELSNIKENKCNGTDAKVKLIKQELDKYKNAVTELQLLMQST
PATNNRARRELPRFMNYTLNNAKKTNVTLSKKRKRRFLGFLCGVGSAIAS
GVAVSKVLHLEGEVNKIKSALLSTNKAVVSLSNGVSVCTSKVLDLKNYID
KQLLPIVNKQSCSISNIETVIEFQQKNNRLLEITREFSVNAGVTTPVSTY
MLTNSELLSLINDMPITNDQKKLMSNNVQIVRQQSYSIMSIIKEEILAYV
VQLPLYGVIDTPCWKLHTSPLCTTNTKEGSNICLTRTDRGWYCDNAGSVS
FFPQAETCKVQSNRVFCDTMCSLTLPSEVNLCNVDIFNPKYDCKIMTSKT
DVSSSVITSLGAIVSCYGKTKCTASNKNRGIIKTFSNGCDYVSNKGVDTV
SVGNTLYYVNKQEGKSLYVKGEPIINFYDPLVFPSSQFSASISQVNEKIN
QSLAFIRKSDELLSAIGGYIPEAPRDGQAYVRKDGEWVLLSTFLGGLVPR
GSHHHHHHGSWSHPQFEK

[Relevant features (amino acid residue coordinates): Signal sequence (not present in final product): 1-25; pep27 (not present in final product): 110-136; F1: 137-513; F2: 26-109; foldon: 518-544; Thrombin recognition sequence: 547-552; His-tag: 553-558; Streptag II: 561-568; Linker sequences: 514-517, 545-546, 559-560; P102A (naturally-occurring substitution); I379V (naturally-occurring substitution); M447V (naturally-occurring substitution); T54H (introduced mutation); S55C (introduced mutation); L142C (introduced mutation); L188C (introduced mutation); V296I (introduced mutation); N371C (introduced mutation); D486S (introduced mutation); E487Q (introduced mutation); D489S (introduced mutation)]

SEQ ID NO:39: Amino Acid Sequence of Precursor Polypeptide of pXCS898:

MELLILKANAITTILTAVTFCFASGQNITEEFYQSTCSAVSKGYLSALRT
GWYHSVITIELSNIKENKCNGTDAKVKLIKQELDKYKNAVTELQLLMQST
PATNNRARRELPRFMNYTLNNAKKTNVTLSKKRKRRFLGFLLGVGSAIAS
GVAVCKVLHLEGEVNKIKSALLSTNKAVVSLSNGVSVLTIKVLDLKNYID
KQLLPIVNKQSCSISNIETVIEFQQKNNRLLEITREFSVNAGVTTPVSTY
MLTNSELLSLINDMPITNDQKKLMSNNVQIVRQQSYSIMCIIKEEILAYW
QLPLYGVIDTPCWKLHTSPLCTTNTKEGSNICLTRTDRGWYCDNAGSVSF
FPQAETCKVQSNRVFCDTMNSLTLPSEVNLCNVDIFNPKYDCKIMTSKTD
VSSSVITSLGAIVSCYGKTKCTASNKNRGIIKTFSNGCDYVSNKGVDTVS
VGNTLYYVNKQEGKSLYVKGEPIINFYDPLVFPSDEFDASISQVNEKINQ
SLAFIRKSDELLSAIGGYIPEAPRDGQAYVRKDGEWVLLSTFLGGLVPRG
SHHHHHHGSWSHPQFEK

[Relevant features (amino acid residue coordinates): Signal sequence (not present in final product): 1-25; pep27 (not present in final product): 110-136; F1: 137-513; F2: 26-109; foldon: 518-544; Thrombin recognition sequence: 547-552; His-tag: 553-558; Streptag II: 561-568; Linker sequences: 514-517, 545-546, 559-560; P102A (naturally-occurring substitution); I379V (naturally-occurring substitution); M447V (naturally-occurring substitution); T54H (introduced mutation); S155C (introduced mutation); S190I (introduced mutation); S290C (introduced mutation); V296I (introduced mutation)]

SEQ ID NO:40: Amino acid Sequence of the T4 Fibritin Foldon:

GYIPEAPRDGQAYVRKDGEWVLLSTFL

SEQ ID NO: 271. Amino Acid Sequence of Precursor Polypeptide of pXCS899

MELLILKANAITTILTAVTFCFASGQNITEEFYQSTCSAVSKGYLSALRT
GWYHCVITIELSNIKENKCNGTDAKVKLIKQELDKYKNAVTELQLLMQST
PATNNRARRELPRFMNYTLNNAKKTNVTLSKKRKRRFLGFLLGVGSAIAS
GVAVSKVLHLEGEVNKIKSALLSTNKAVVSLSNGVSVCTSKVLDLKNYID
KQLLPIVNKQSCSISNIETVIEFQQKNNRLLEITREFSVNAGVTTPVSTY
MLTNSELLSLINDMPITNDQKKLMSNNVQIVRQQSYSIMSIIKEEVLAYW
QLPLYGVIDTPCWKLHTSPLCTTNTKEGSNICLTRTDRGWYCDNAGSVSF
FPQAETCKVQSNRVFCDTMNSLTLPSEVNLCNVDIFNPKYDCKIMTSKTD
VSSSVITSLGAIVSCYGKTKCTASNKNRGIIKTFSNGCDYVSNKGVDTVS
VGNTLYYVNKQEGKSLYVKGEPIINFYDPLVFPSSEFDASISQVNEKINQ
SLAFIRKSDELLGGLVPRGSHHHHHHGSWSHPQFEK

SEQ ID NO: 272. Amino Acid Sequence of Precursor Polypeptide of pXCS1106

MELLILKANAITTILTAVTFCFASGQNITEEFYQSTCSAVSKGYLSALRT
GWYHCVITIELSNIKENKCNGTDAKVKLIKQELDKYKNAVTELQLLMQST
PATGSAIASGVAVSKVLHLEGEVNKIKSALLSTNKAVVSLSNGVSVCTSK
VLDLKNYIDKQLLPIVNKQSCSISNIETVIEFQQKNNRLLEITREFSVNA
GVTTPVSTYMLTNSELLSLINDMPITNDQKKLMSNNVQIVRQQSYSIMSI
IKEEVLAYVVQLPLYGVIDTPCWKLHTSPLCTTNTKEGSNICLTRTDRGW
YCDNAGSVSFFPQAETCKVQSNRVFCDTMNSLTLPSEVNLCNVDIFNPKY
DCKIMTSKTDVSSSVITSLGAIVSCYGKTKCTASNKNRGIIKTFSNGCDY
VSNKGVDTVSVGNTLYYVNKQEGKSLYVKGEPIINFYDPLVFPSSEFDAS
ISQVNEKINQSLAFIRCCDELLHNVNAGKSTTNIMITTLVPRGSGGSAIG
GYIPEAPRDGQAYVRKDGEWVLLSTFLGGHHHHHHGSWSHPQFEK

SEQ ID NO: 273. Amino Acid Sequence of Precursor Polypeptide of pXCS1107

MELLILKANAITTILTAVTFCFASGQNITEEFYQSTCSAVSKGYLSALRT
GWYHCVITIELSNIKENKCNGTDAKVKLIKQELDKYKNAVTELQLLMQST

PATGSAIASGVAVSKVLHLEGEVNKIKSALLSTNKAVVSLSNGVSVCTSK

VLDLKNYIDKQLLPIVNKQSCSISNIETVIEFQQKNNRLLEITREFSVNA

GVTTPVSTYMLTNSELLSLINDMPITNDQKKLMSNNVQIVRQQSYSIMSI

IKEEVLAYVVQLPLYGVIDTPCWKLHTSPLCTTNTKEGSNICLTRTDRGW

YCDNAGSVSFFPQAETCKVQSNRVFCDTMNSLTLPSEVNLCNVDIFNPKY

DCKIMTSKTDVSSSVITSLGAIVSCYGKTKCTASNKNRGIIKTFSNGCDY

VSNKGVDTVSVGNTLYYVNKQEGKSLYVKGEPIINFYDPLVFPSSEFDAS

ISQVNEKINQSLAFIRKSDELLHCCNAGKSTTNIMITTLVPRGSGGSAIG

GYIPEAPRDGQAYVRKDGEWVLLSTFLGGHHHHHHGSWSHPQFEK

SEQ ID NO: 274. Amino Acid Sequence of Precursor Polypeptide of pXCS1108

MELLILKANAITTILTAVTFCFASGQNITEEFYQSTCSAVSKGYLSALRT

GWYHCVITIELSNIKENKCNGTDAKVKLIKQELDKYKNAVTELQLLMQST

PATGSAIASGVAVSKVLHLEGEVNKIKSALLSTNKAVVSLSNGVSVCTSK

VLDLKNYIDKQLLPIVNKQSCSISNIETVIEFQQKNNRLLEITREFSVNA

GVTTPVSTYMLTNSELLSLINDMPITNDQKKLMSNNVQIVRQQSYSIMSI

IKEEVLAYVVQLPLYGVIDTPCWKLHTSPLCTTNTKEGSNICLTRTDRGW

YCDNAGSVSFFPQAETCKVQSNRVFCDTMNSLTLPSEVNLCNVDIFNPKY

DCKIMTSKTDVSSSVITSLGAIVSCYGKTKCTASNKNRGIIKTFSNGCDY

VSNKGVDTVSVGNTLYYVNKQEGKSLYVKGEPIINFYDPLVFPSSEFDAS

ISQVNEKINQSLAFIRKSDELLHNVNAGKSCCNIMITTLVPRGSGGSAIG

GYIPEAPRDGQAYVRKDGEWVLLSTFLGGHHHHHHGSWSHPQFEK

SEQ ID NO: 275. Amino Acid Sequence of Precursor Polypeptide of pXCS1109

MELLILKANAITTILTAVTFCFASGQNITEEFYQSTCSAVSKGYLSALRT

GWYHCVITIELSNIKENKCNGTDAKVKLIKQELDKYKNAVTELQLLMQST

PATGSAIASGVAVSKVLHLEGEVNKIKSALLSTNKAVVSLSNGVSVCTSK

VLDLKNYIDKQLLPIVNKQSCSISNIETVIEFQQKNNRLLEITREFSVNA

GVTTPVSTYMLTNSELLSLINDMPITNDQKKLMSNNVQIVRQQSYSIMSI

IKEEVLAYVVQLPLYGVIDTPCWKLHTSPLCTTNTKEGSNICLTRTDRGW

YCDNAGSVSFFPQAETCKVQSNRVFCDTMNSLTLPSEVNLCNVDIFNPKY

DCKIMTSKTDVSSSVITSLGAIVSCYGKTKCTASNKNRGIIKTFSNGCDY

VSNKGVDTVSVGNTLYYVNKQEGKSLYVKGEPIINFYDPLVFPSSEFDAS

ISQVNEKINQSLAFIRCCDELLHCCNAGKSTTNIMITTLVPRGSGGSAIG

GYIPEAPRDGQAYVRKDGEWVLLSTFLGGHHHHHHGSWSHPQFEK

SEQ ID NO: 276. Amino Acid Sequence of Precursor Polypeptide of pXCS1110

MELLILKANAITTILTAVTFCFASGQNITEEFYQSTCSAVSKGYLSALRT

GWYHCVITIELSNIKENKCNGTDAKVKLIKQELDKYKNAVTELQLLMQST

PATGSAIASGVAVSKVLHLEGEVNKIKSALLSTNKAVVSLSNGVSVCTSK

VLDLKNYIDKQLLPIVNKQSCSISNIETVIEFQQKNNRLLEITREFSVNA

GVTTPVSTYMLTNSELLSLINDMPITNDQKKLMSNNVQIVRQQSYSIMSI

IKEEVLAYVVQLPLYGVIDTPCWKLHTSPLCTTNTKEGSNICLTRTDRGW

YCDNAGSVSFFPQAETCKVQSNRVFCDTMNSLTLPSEVNLCNVDIFNPKY

DCKIMTSKTDVSSSVITSLGAIVSCYGKTKCTASNKNRGIIKTFSNGCDY

VSNKGVDTVSVGNTLYYVNKQEGKSLYVKGEPIINFYDPLVFPSSEFDAS

ISQVNEKINQSLAFIRCCDELLHNVNAGKSCCNIMITTLVPRGSGGSAIG

GYIPEAPRDGQAYVRKDGEWVLLSTFLGGHHHHHHGSWSHPQFEK

SEQ ID NO: 277. Amino Acid Sequence of Precursor Polypeptide of pXCS1111

MELLILKANAITTILTAVTFCFASGQNITEEFYQSTCSAVSKGYLSALRT

GWYHCVITIELSNIKENKCNGTDAKVKLIKQELDKYKNAVTELQLLMQST

PATGSAIASGVAVSKVLHLEGEVNKIKSALLSTNKAVVSLSNGVSVCTSK

VLDLKNYIDKQLLPIVNKQSCSISNIETVIEFQQKNNRLLEITREFSVNA

GVTTPVSTYMLTNSELLSLINDMPITNDQKKLMSNNVQIVRQQSYSIMSI

IKEEVLAYVVQLPLYGVIDTPCWKLHTSPLCTTNTKEGSNICLTRTDRGW

YCDNAGSVSFFPQAETCKVQSNRVFCDTMNSLTLPSEVNLCNVDIFNPKY

DCKIMTSKTDVSSSVITSLGAIVSCYGKTKCTASNKNRGIIKTFSNGCDY

VSNKGVDTVSVGNTLYYVNKQEGKSLYVKGEPIINFYDPLVFPSSEFDAS

ISQVNEKINQSLAFIRKSDELLHCCNAGKSCCNIMITTLVPRGSGGSAIG

GYIPEAPRDGQAYVRKDGEWVLLSTFLGGHHHHHHGSWSHPQFEK

SEQ ID NO: 278. Amino Acid Sequence of Precursor Polypeptide of pXCS1112

MELLILKANAITTILTAVTFCFASGQNITEEFYQSTCSAVSKGYLSALRT

GWYHCVITIELSNIKENKCNGTDAKVKLIKQELDKYKNAVTELQLLMQST

PATGSAIASGVAVSKVLHLEGEVNKIKSALLSTNKAVVSLSNGVSVCTSK

VLDLKNYIDKQLLPIVNKQSCSISNIETVIEFQQKNNRLLEITREFSVNA

GVTTPVSTYMLTNSELLSLINDMPITNDQKKLMSNNVQIVRQQSYSIMSI

IKEEVLAYVVQLPLYGVIDTPCWKLHTSPLCTTNTKEGSNICLTRTDRGW

YCDNAGSVSFFPQAETCKVQSNRVFCDTMNSLTLPSEVNLCNVDIFNPKY

DCKIMTSKTDVSSSVITSLGAIVSCYGKTKCTASNKNRGIIKTFSNGCDY

VSNKGVDTVSVGNTLYYVNKQEGKSLYVKGEPIINFYDPLVFPSSEFDAS

ISQVNEKINQSLAFIRCCDELLHCCNAGKSCCNIMITTLVPRGSGGSAIG

GYIPEAPRDGQAYVRKDGEWVLLSTFLGGHHHHHHGSWSHPQFEK

SEQUENCE LISTING (326 sequences)

SEQ ID NO: 1 - protein, 574 aa, Human respiratory syncytial virus
MELLILKANAITTILTAVTFCFASGQNITEEFYQSTCSAVSKGYLSALRTGWYTSVITIELSNIKENKCNGTDAKVKLIKQELDKYKNAVTELQLLMQSTPPTNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEINLCNVDIFNPKYDCKIMTSKTDVSSSVITSLGAIVSCYGKTKCTASNKNRGIIKTFSNGCDYVSNKGMDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 2 - protein, 574 aa, Human respiratory syncytial virus
MELLIHRSSAIFLTLAVNALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNRLLPIVNQQSCRISNIETVIEFQQMNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 3 - protein, 568 aa, Artificial Sequence
  synthetic polypeptide
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHGSWSHPQFEK

SEQ ID NO: 4 - protein, 574 aa, Human respiratory syncytial virus
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 5 - protein, 568 aa, Artificial Sequence
  synthetic polypeptide
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHGSWSHPQFEK

SEQ ID NO: 6 - protein, 574 aa, Human respiratory syncytial virus
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 7 - protein, 568 aa, Artificial Sequence
  synthetic peptide
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLSAIGGYIPEAPRDGQAYVRKDGEWVLLSTFLGGLVPRGSHHHHHHGSWSHPQFEK

SEQ ID NO: 8 - DNA, 1707 bp, Artificial Sequence
  Synthetic
atggaacttctgatcctgaaagccaacgcgattaccactatcctgactgccgtcaccttctgcttcgcatcgggacagaacattaccgaggagttctaccagtccacctgttcggcggtgtccaagggttacctctcggccctgagaactggctggtaccactgtgtgattactatcgagctgagcaacatcaaggagaacaagtgcaatggaacggacgcgaaggtcaagctgattaagcaggaactcgataagtacaagaacgccgtgaccgagctccagctgctgatgcaatcgacccctgccactaacaacagagctcgccgggaactgccgcgcttcatgaattacaccctcaacaacgcgaagaaaaccaacgtgaccctgtccaagaagcgcaagcggaggttcctgggattcctgtgtggcgtgggctccgcaatcgcatccggagtggccgtgtccaaagtgctgcatctggagggggaagtgaacaagatcaagtccgccctcctgtcaactaataaggcggtggtgtccctgagcaacggagtcagcgtgtgtacatccaaggtcctggacctcaagaactacatcgacaagcagctgttgcccatcgtcaacaagcagtcatgctcgattagcaatatcgaaaccgtgattgagttccagcagaagaacaacagactgctcgaaattacccgggagttttccgtgaacgccggagtgaccactcctgtgtccacctacatgcttacgaactccgaactgctcagcctcatcaacgatatgccgatcactaacgaccagaagaagttgatgagcaacaatgtgcagatcgtgcgccaacagtcctactcaatcatgtcaattatcaaggaggaaatcctcgcctatgtggtgcaattgcctctgtacggagtcatcgacacaccctgctggaagctgcacactagcccactctgtacgaccaacaccaaggaaggttccaacatctgcctgactaggaccgatcggggctggtattgcgataatgctgggtccgtgagcttcttcccgcaagccgagacttgcaaagtgcagtcaaaccgcgtgttctgtgacaccatgtgtagcctgaccctgccatccgaagtcaacctctgcaacgtggacatctttaacccgaaatacgactgcaagattatgacctccaagaccgacgtcagcagctctgtcatcactagcctgggagctattgtgtcctgctacggaaagaccaaatgcactgcctcgaacaagaacagaggcatcatcaagaccttcagcaacggctgtgactacgtgtccaacaagggagtggacaccgtgtccgtcgggaacaccctgtactacgtgaacaagcaggaggggaagtcgctctacgtcaagggggaaccgattatcaatttctacgaccccctggtgttcccttccgacgagttcgatgcctccatatcccaagtcaacgagaagatcaaccagtctcttgccttcatccggaagtcggacgaactgctgtccgccatcggtggctatattccggaagcccccagggatggacaggcctacgtgcggaaggatggagaatgggtgcttttgtccaccttcctgggcggtctggtgccccgcggctcacaccatcatcaccaccacggttcgtggtcccaccctcaatttgagaagtga

SEQ ID NO: 9 - DNA, 1707 bp, Artificial Sequence
  synthetic
atggaacttctgatcctgaaagccaacgcgattaccactatcctgactgccgtcaccttctgcttcgcatcgggacagaacattaccgaggagttctaccagtccacctgttcggcggtgtccaagggttacctctcggccctgagaactggctggtacacctgtgtgattactatcgagctgagcaacatcaaggagaacaagtgcaatggaacggacgcgaaggtcaagctgattaagcaggaactcgataagtacaagaacgccgtgaccgagctccagctgctgatgcaatcgacccctgccactaacaacagagctcgccgggaactgccgcgcttcatgaattacaccctcaacaacgcgaagaaaaccaacgtgaccctgtccaagaagcgcaagcggaggttcctgggattcctgttgggcgtgggctccgcaatcgcatccggagtggccgtgtccaaagtgctgcatctggagggggaagtgaacaagatcaagtccgccctcctgtcaactaataaggcggtggtgtccctgagcaacggagtcagcgtgtgtacatccaaggtcctggacctcaagaactacatcgacaagcagctgttgcccatcgtcaacaagcagtcatgctcgattagcaatatcgaaaccgtgattgagttccagcagaagaacaacagactgctcgaaattacccgggagttttccgtgaacgccggagtgaccactcctgtgtccacctacatgcttacgaactccgaactgctcagcctcatcaacgatatgccgatcactaacgaccagaagaagttgatgagcaacaatgtgcagatcgtgcgccaacagtcctactcaatcatgtcaattatcaaggaggaagtgctcgcctatgtggtgcaattgcctctgtacggagtcatcgacacaccctgctggaagctgcacactagcccactctgtacgaccaacaccaaggaaggttccaacatctgcctgactaggaccgatcggggctggtattgcgataatgctgggtccgtgagcttcttcccgcaagccgagacttgcaaagtgcagtcaaaccgcgtgttctgtgacaccatgaacagcctgaccctgccatccgaagtcaacctctgcaacgtggacatctttaacccgaaatacgactgcaagattatgacctccaagaccgacgtcagcagctctgtcatcactagcctgggagctattgtgtcctgctacggaaagaccaaatgcactgcctcgaacaagaacagaggcatcatcaagaccttcagcaacggctgtgactacgtgtccaacaagggagtggacaccgtgtccgtcgggaacaccctgtactacgtgaacaagcaggaggggaagtcgctctacgtcaagggggaaccgattatcaatttctacgaccccctggtgttcccttcctccgagttcgatgcctccatatcccaagtcaacgagaagatcaaccagtctcttgccttcatccggaagtcggacgaactgctgtccgccatcggtggctatattccggaagcccccagggatggacaggcctacgtgcggaaggatggagaatgggtgcttttgtccaccttcctgggcggtctggtgccccgcggctcacaccatcatcaccaccacggttcgtggtcccaccctcaatttgagaagtga

SEQ ID NO: 10 - DNA, 1707 bp, Artificial Sequence
  synthetic
atggaacttctgatcctgaaagccaacgcgattaccactatcctgactgccgtcaccttctgcttcgcatcgggacagaacattaccgaggagttctaccagtccacctgttcggcggtgtccaagggttacctctcggccctgagaactggctggtaccactgtgtgattactatcgagctgagcaacatcaaggagaacaagtgcaatggaacggacgcgaaggtcaagctgattaagcaggaactcgataagtacaagaacgccgtgaccgagctccagctgctgatgcaatcgacccctgccactaacaacagagctcgccgggaactgccgcgcttcatgaattacaccctcaacaacgcgaagaaaaccaacgtgaccctgtccaagaagcgcaagcggaggttcctgggattcctgttgggcgtgggctccgcaatcgcatccggagtggccgtgtccaaagtgctgcatctggagggggaagtgaacaagatcaagtccgccctcctgtcaactaataaggcggtggtgtccctgagcaacggagtcagcgtgtgtacaatcaaggtcctggacctcaagaactacatcgacaagcagctgttgcccatcgtcaacaagcagtcatgctcgattagcaatatcgaaaccgtgattgagttccagcagaagaacaacagactgctcgaaattacccgggagttttccgtgaacgccggagtgaccactcctgtgtccacctacatgcttacgaactccgaactgctcagcctcatcaacgatatgccgatcactaacgaccagaagaagttgatgagcaacaatgtgcagatcgtgcgccaacagtcctactcaatcatgtcaattatcaaggaggaagtgctcgcctatgtggtgcaattgcctctgtacggagtcatcgacacaccctgctggaagctgcacactagcccactctgtacgaccaacaccaaggaaggttccaacatctgcctgactaggaccgatcggggctggtattgcgataatgctgggtccgtgagcttcttcccgcaagccgagacttgcaaagtgcagtcaaaccgcgtgttctgtgacaccatgaacagcctgaccctgccatccgaagtcaacctctgcaacgtggacatctttaacccgaaatacgactgcaagattatgacctccaagaccgacgtcagcagctctgtcatcactagcctgggagctattgtgtcctgctacggaaagaccaaatgcactgcctcgaacaagaacagaggcatcatcaagaccttcagcaacggctgtgactacgtgtccaacaagggagtggacaccgtgtccgtcgggaacaccctgtactacgtgaacaagcaggaggggaagtcgctctacgtcaagggggaaccgattatcaatttctacgaccccctggtgttcccttccgacgagttcgatgcctccatatcccaagtcaacgagaagatcaaccagtctcttgccttcatccggaagtcggacgaactgctgtccgccatcggtggctatattccggaagcccccagggatggacaggcctacgtgcggaaggatggagaatgggtgcttttgtccaccttcctgggcggtctggtgccccgcggctcacaccatcatcaccaccacggttcgtggtcccaccctcaatttgagaagtga

SEQ ID NO: 11 - DNA, 1707 bp, Artificial Sequence
  synthetic
atggaacttctgatcctgaaagccaacgcgattaccactatcctgactgccgtcaccttctgcttcgcatcgggacagaacattaccgaggagttctaccagtccacctgttcggcggtgtccaagggttacctctcggccctgagaactggctggtacaccagcgtgattactatcgagctgagcaacatcaaggagaacaagtgcaatggaacggacgcgaaggtcaagctgattaagcaggaactcgataagtacaagaacgccgtgaccgagctccagctgctgatgcaatcgacccctgcctgtaacaacagagctcgccgggaactgccgcgcttcatgaattacaccctcaacaacgcgaagaaaaccaacgtgaccctgtccaagaagcgcaagcggaggttcctgggattcctgttgggcgtgggctccgcatgtgcatccggagtggccgtgtccaaagtgctgcatctggagggggaagtgaacaagatcaagtccgccctcctgtcaactaataaggcggtggtgtccctgagcaacggagtcagcgtgctgacaatcaaggtcctggacctcaagaactacatcgacaagcagctgttgcccatcgtcaacaagcagtcatgctcgattagcaatatcgaaaccgtgattgagttccagcagaagaacaacagactgctcgaaattacccgggagttttccgtgaacgccggagtgaccactcctgtgtccacctacatgcttacgaactccgaactgctcagcctcatcaacgatatgccgatcactaacgaccagaagaagttgatgagcaacaatgtgcagatcgtgcgccaacagtcctactcaatcatgtcaattatcaaggaggaagtgctcgcctatgtggtgcaattgcctctgtacggagtcatcgacacaccctgctggaagctgcacactagcccactctgtacgaccaacaccaaggaaggttccaacatctgcctgactaggaccgatcggggctggtattgcgataatgctgggtccgtgagcttcttcccgcaagccgagacttgcaaagtgcagtcaaaccgcgtgttctgtgacaccatgaacagcctgaccctgccatccgaagtcaacctctgcaacgtggacatctttaacccgaaatacgactgcaagattatgacctccaagaccgacgtcagcagctctgtcatcactagcctgggagctattgtgtcctgctacggaaagaccaaatgcactgcctcgaacaagaacagaggcatcatcaagaccttcagcaacggctgtgactacgtgtccaacaagggagtggacaccgtgtccgtcgggaacaccctgtactacgtgaacaagcaggaggggaagtcgctctacgtcaagggggaaccgattatcaatttctacgaccccctggtgttcccttcctccgagttcgatgcctccatatcccaagtcaacgagaagatcaaccagtctcttgccttcatccggaagtcggacgaactgctgtccgccatcggtggctatattccggaagcccccagggatggacaggcctacgtgcggaaggatggagaatgggtgcttttgtccaccttcctgggcggtctggtgccccgcggctcacaccatcatcaccaccacggttcgtggtcccaccctcaatttgagaagtga

SEQ ID NO: 12 - DNA, 1707 bp, Artificial Sequence
  synthetic
atggaacttctgatcctgaaagccaacgcgattaccactatcctgactgccgtcaccttctgcttcgcatcgggacagaacattaccgaggagttctaccagtccacctgttcggcggtgtccaagggttacctctcggccctgagaactggctggtaccacagcgtgattactatcgagctgagcaacatcaaggagaacaagtgcaatggaacggacgcgaaggtcaagctgattaagcaggaactcgataagtacaagaacgccgtgaccgagctccagctgctgatgcaatcgacccctgcctgtaacaacagagctcgccgggaactgccgcgcttcatgaattacaccctcaacaacgcgaagaaaaccaacgtgaccctgtccaagaagcgcaagcggaggttcctgggattcctgttgggcgtgggctccgcatgtgcatccggagtggccgtgtccaaagtgctgcatctggagggggaagtgaacaagatcaagtccgccctcctgtcaactaataaggcggtggtgtccctgagcaacggagtcagcgtgctgacaatcaaggtcctggacctcaagaactacatcgacaagcagctgttgcccatcgtcaacaagcagtcatgctcgattagcaatatcgaaaccgtgattgagttccagcagaagaacaacagactgctcgaaattacccgggagttttccgtgaacgccggagtgaccactcctgtgtccacctacatgcttacgaactccgaactgctcagcctcatcaacgatatgccgatcactaacgaccagaagaagttgatgagcaacaatgtgcagatcgtgcgccaacagtcctactcaatcatgtcaattatcaaggaggaaatcctcgcctatgtggtgcaattgcctctgtacggagtcatcgacacaccctgctggaagctgcacactagcccactctgtacgaccaacaccaaggaaggttccaacatctgcctgactaggaccgatcggggctggtattgcgataatgctgggtccgtgagcttcttcccgcaagccgagacttgcaaagtgcagtcaaaccgcgtgttctgtgacaccatgaacagcctgaccctgccatccgaagtcaacctctgcaacgtggacatctttaacccgaaatacgactgcaagattatgacctccaagaccgacgtcagcagctctgtcatcactagcctgggagctattgtgtcctgctacggaaagaccaaatgcactgcctcgaacaagaacagaggcatcatcaagaccttcagcaacggctgtgactacgtgtccaacaagggagtggacaccgtgtccgtcgggaacaccctgtactacgtgaacaagcaggaggggaagtcgctctacgtcaagggggaaccgattatcaatttctacgaccccctggtgttcccttcctccgagttcgatgcctccatatcccaagtcaacgagaagatcaaccagtctcttgccttcatccggaagtcggacgaactgctgtccgccatcggtggctatattccggaagcccccagggatggacaggcctacgtgcggaaggatggagaatgggtgcttttgtccaccttcctgggcggtctggtgccccgcggctcacaccatcatcaccaccacggttcgtggtcccaccctcaatttgagaagtga

SEQ ID NO: 13 - DNA, 1707 bp, Artificial Sequence
  synthetic
atggaacttctgatcctgaaagccaacgcgattaccactatcctgactgccgtcaccttctgcttcgcatcgggacagaacattaccgaggagttctaccagtccacctgttcggcggtgtccaagggttacctctcggccctgagaactggctggtaccactgtgtgattactatcgagctgagcaacatcaaggagaacaagtgcaatggaacggacgcgaaggtcaagctgattaagcaggaactcgataagtacaagaacgccgtgaccgagctccagctgctgatgcaatcgacccctgccactaacaacagagctcgccgggaactgccgcgcttcatgaattacaccctcaacaacgcgaagaaaaccaacgtgaccctgtccaagaagcgcaagcggaggttcctgggattcctgttgggcgtgggctccgcaatcgcatccggagtggccgtgtccaaagtgctgcatctggagggggaagtgaacaagatcaagtccgccctcctgtcaactaataaggcggtggtgtccctgagcaacggagtcagcgtgtgtacatccaaggtcctggacctcaagaactacatcgacaagcagctgttgcccatcgtcaacaagcagtcatgctcgattagcaatatcgaaaccgtgattgagttccagcagaagaacaacagactgctcgaaattacccgggagttttccgtgaacgccggagtgaccactcctgtgtccacctacatgcttacgaactccgaactgctcagcctcatcaacgatatgccgatcactaacgaccagaagaagttgatgagcaacaatgtgcagatcgtgcgccaacagtcctactcaatcatgtcaattatcaaggaggaagtgctcgcctatgtggtgcaattgcctctgtacggagtcatcgacacaccctgctggaagctgcacactagcccactctgtacgaccaacaccaaggaaggttccaacatctgcctgactaggaccgatcggggctggtattgcgataatgctgggtccgtgagcttcttcccgcaagccgagacttgcaaagtgcagtcaaaccgcgtgttctgtgacaccatgaacagcctgaccctgccatccgaagtcaacctctgcaacgtggacatctttaacccgaaatacgactgcaagattatgacctccaagaccgacgtcagcagctctgtcatcactagcctgggagctattgtgtcctgctacggaaagaccaaatgcactgcctcgaacaagaacagaggcatcatcaagaccttcagcaacggctgtgactacgtgtccaacaagggagtggacaccgtgtccgtcgggaacaccctgtactacgtgaacaagcaggaggggaagtcgctctacgtcaagggggaaccgattatcaatttctacgaccccctggtgttcccttcctccgagttcgatgcctccatatcccaagtcaacgagaagatcaaccagtctcttgccttcatccggaagtcggacgaactgctgtccgccatcggtggctatattccggaagcccccagggatggacaggcctacgtgcggaaggatggagaatgggtgcttttgtccaccttcctgggcggtctggtgccccgcggctcacaccatcatcaccaccacggttcgtggtcccaccctcaatttgagaagtga

SEQ ID NO: 14 - DNA, 1707 bp, Artificial Sequence
  synthetic
atggaacttctgatcctgaaagccaacgcgattaccactatcctgactgccgtcaccttctgcttcgcatcgggacagaacattaccgaggagttctaccagtccacctgttcggcggtgtccaagggttacctctcggccctgagaactggctggtacacctgtgtgattactatcgagctgagcaacatcaaggagaacaagtgcaatggaacggacgcgaaggtcaagctgattaagcaggaactcgataagtacaagaacgccgtgaccgagctccagctgctgatgcaatcgacccctgccactaacaacagagctcgccgggaactgccgcgcttcatgaattacaccctcaacaacgcgaagaaaaccaacgtgaccctgtccaagaagcgcaagcggaggttcctgggattcctgttgggcgtgggctccgcaatcgcatccggagtggccgtgtccaaagtgctgcatctggagggggaagtgaacaagatcaagtccgccctcctgtcaactaataaggcggtggtgtccctgagcaacggagtcagcgtgtgtacaatcaaggtcctggacctcaagaactacatcgacaagcagctgttgcccatcgtcaacaagcagtcatgctcgattagcaatatcgaaaccgtgattgagttccagcagaagaacaacagactgctcgaaattacccgggagttttccgtgaacgccggagtgaccactcctgtgtccacctacatgcttacgaactccgaactgctcagcctcatcaacgatatgccgatcactaacgaccagaagaagttgatgagcaacaatgtgcagatcgtgcgccaacagtcctactcaatcatgtcaattatcaaggaggaagtgctcgcctatgtggtgcaattgcctctgtacggagtcatcgacacaccctgctggaagctgcacactagcccactctgtacgaccaacaccaaggaaggttccaacatctgcctgactaggaccgatcggggctggtattgcgataatgctgggtccgtgagcttcttcccgcaagccgagacttgcaaagtgcagtcaaaccgcgtgttctgtgacaccatgaacagcctgaccctgccatccgaagtcaacctctgcaacgtggacatctttaacccgaaatacgactgcaagattatgacctccaagaccgacgtcagcagctctgtcatcactagcctgggagctattgtgtcctgctacggaaagaccaaatgcactgcctcgaacaagaacagaggcatcatcaagaccttcagcaacggctgtgactacgtgtccaacaagggagtggacaccgtgtccgtcgggaacaccctgtactacgtgaacaagcaggaggggaagtcgctctacgtcaagggggaaccgattatcaatttctacgaccccctggtgttcccttcctccgagttcgatgcctccatatcccaagtcaacgagaagatcaaccagtctcttgccttcatccggaagtcggacgaactgctgtccgccatcggtggctatattccggaagcccccagggatggacaggcctacgtgcggaaggatggagaatgggtgcttttgtccaccttcctgggcggtctggtgccccgcggctcacaccatcatcaccaccacggttcgtggtcccaccctcaatttgagaagtga

SEQ ID NO: 15 - DNA, 1707 bp, Artificial Sequence
  synthetic
atggaacttctgatcctgaaagccaacgcgattaccactatcctgactgccgtcaccttctgcttcgcatcgggacagaacattaccgaggagttctaccagtccacctgttcggcggtgtccaagggttacctctcggccctgagaactggctggtaccactgtgtgattactatcgagctgagcaacatcaaggagaacaagtgcaatggaacggacgcgaaggtcaagctgattaagcaggaactcgataagtacaagaacgccgtgaccgagctccagctgctgatgcaatcgacccctgccactaacaacagagctcgccgggaactgccgcgcttcatgaattacaccctcaacaacgcgaagaaaaccaacgtgaccctgtccaagaagcgcaagcggaggttcctgggattcctgttgggcgtgggctccgcaatcgcatccggagtggccgtgtccaaagtgctgcatctggagggggaagtgaacaagatcaagtccgccctcctgtcaactaataaggcggtggtgtccctgagcaacggagtcagcgtgtgtacaatcaaggtcctggacctcaagaactacatcgacaagcagctgttgcccatcgtcaacaagcagtcatgctcgattagcaatatcgaaaccgtgattgagttccagcagaagaacaacagactgctcgaaattacccgggagttttccgtgaacgccggagtgaccactcctgtgtccacctacatgcttacgaactccgaactgctcagcctcatcaacgatatgccgatcactaacgaccagaagaagttgatgagcaacaatgtgcagatcgtgcgccaacagtcctactcaatcatgtcaattatcaaggaggaagtgctcgcctatgtggtgcaattgcctctgtacggagtcatcgacacaccctgctggaagctgcacactagcccactctgtacgaccaacaccaaggaaggttccaacatctgcctgactaggaccgatcggggctggtattgcgataatgctgggtccgtgagcttcttcccgcaagccgagacttgcaaagtgcagtcaaaccgcgtgttctgtgacaccatgaacagcctgaccctgccatccgaagtcaacctctgcaacgtggacatctttaacccgaaatacgactgcaagattatgacctccaagaccgacgtcagcagctctgtcatcactagcctgggagctattgtgtcctgctacggaaagaccaaatgcactgcctcgaacaagaacagaggcatcatcaagaccttcagcaacggctgtgactacgtgtccaacaagggagtggacaccgtgtccgtcgggaacaccctgtactacgtgaacaagcaggaggggaagtcgctctacgtcaagggggaaccgattatcaatttctacgaccccctggtgttcccttcctccgagttcgatgcctccatatcccaagtcaacgagaagatcaaccagtctcttgccttcatccggaagtcggacgaactgctgtccgccatcggtggctatattccggaagcccccagggatggacaggcctacgtgcggaaggatggagaatgggtgcttttgtccaccttcctgggcggtctggtgccccgcggctcacaccatcatcaccaccacggttcgtggtcccaccctcaatttgagaagtga

SEQ ID NO: 16 - DNA, 1707 bp, Artificial Sequence
  synthetic
atggaacttctgatcctgaaagccaacgcgattaccactatcctgactgccgtcaccttctgcttcgcatcgggacagaacattaccgaggagttctaccagtccacctgttcggcggtgtccaagggttacctctcggccctgagaactggctggtacaccagcgtgattactatcgagctgagcaacatcaaggagaacaagtgcaatggaacggacgcgaaggtcaagctgattaagcaggaactcgataagtacaagaacgccgtgaccgagctccagctgctgatgcaatcgacccctgccactaacaacagagctcgccgggaactgccgcgcttcatgaattacaccctcaacaacgcgaagaaaaccaacgtgaccctgtccaagaagcgcaagcggaggttcctgggattcctgttgggcgtgggctccgcaatcgcatccggagtggccgtgtgtaaagtgctgcatctggagggggaagtgaacaagatcaagtccgccctcctgtcaactaataaggcggtggtgtccctgagcaacggagtcagcgtgctgacaatcaaggtcctggacctcaagaactacatcgacaagcagctgttgcccatcgtcaacaagcagtcatgctcgattagcaatatcgaaaccgtgattgagttccagcagaagaacaacagactgctcgaaattacccgggagttttccgtgaacgccggagtgaccactcctgtgtccacctacatgcttacgaactccgaactgctcagcctcatcaacgatatgccgatcactaacgaccagaagaagttgatgagcaacaatgtgcagatcgtgcgccaacagtcctactcaatcatgtgcattatcaaggaggaagtgctcgcctatgtggtgcaattgcctctgtacggagtcatcgacacaccctgctggaagctgcacactagcccactctgtacgaccaacaccaaggaaggttccaacatctgcctgactaggaccgatcggggctggtattgcgataatgctgggtccgtgagcttcttcccgcaagccgagacttgcaaagtgcagtcaaaccgcgtgttctgtgacaccatgaacagcctgaccctgccatccgaagtcaacctctgcaacgtggacatctttaacccgaaatacgactgcaagattatgacctccaagaccgacgtcagcagctctgtcatcactagcctgggagctattgtgtcctgctacggaaagaccaaatgcactgcctcgaacaagaacagaggcatcatcaagaccttcagcaacggctgtgactacgtgtccaacaagggagtggacaccgtgtccgtcgggaacaccctgtactacgtgaacaagcaggaggggaagtcgctctacgtcaagggggaaccgattatcaatttctacgaccccctggtgttcccttcctccgagttcgatgcctccatatcccaagtcaacgagaagatcaaccagtctcttgccttcatccggaagtcggacgaactgctgtccgccatcggtggctatattccggaagcccccagggatggacaggcctacgtgcggaaggatggagaatgggtgcttttgtccaccttcctgggcggtctggtgccccgcggctcacaccatcatcaccaccacggttcgtggtcccaccctcaatttgagaagtga

SEQ ID NO: 17 - DNA, 1707 bp, Artificial Sequence
  synthetic
atggaacttctgatcctgaaagccaacgcgattaccactatcctgactgccgtcaccttctgcttcgcatcgggacagaacattaccgaggagttctaccagtccacctgttcggcggtgtccaagggttacctctcggccctgagaactggctggtaccactgtgtgattactatcgagctgagcaacatcaaggagaacaagtgcaatggaacggacgcgaaggtcaagctgattaagcaggaactcgataagtacaagaacgccgtgaccgagctccagctgctgatgcaatcgacccctgccactaacaacagagctcgccgggaactgccgcgcttcatgaattacaccctcaacaacgcgaagaaaaccaacgtgaccctgtccaagaagcgcaagcggaggttcctgggattcctgtgtggcgtgggctccgcaatcgcatccggagtggccgtgtccaaagtgctgcatctggagggggaagtgaacaagatcaagtccgccctcctgtcaactaataaggcggtggtgtccctgagcaacggagtcagcgtgtgtacatccaaggtcctggacctcaagaactacatcgacaagcagctgttgcccatcgtcaacaagcagtcatgctcgattagcaatatcgaaaccgtgattgagttccagcagaagaacaacagactgctcgaaattacccgggagttttccgtgaacgccggagtgaccactcctgtgtccacctacatgcttacgaactccgaactgctcagcctcatcaacgatatgccgatcactaacgaccagaagaagttgatgagcaacaatgtgcagatcgtgcgccaacagtcctactcaatcatgtcaattatcaaggaggaaatcctcgcctatgtggtgcaattgcctctgtacggagtcatcgacacaccctgctggaagctgcacactagcccactctgtacgaccaacaccaaggaaggttccaacatctgcctgactaggaccgatcggggctggtattgcgataatgctgggtccgtgagcttcttcccgcaagccgagacttgcaaagtgcagtcaaaccgcgtgttctgtgacaccatgtgtagcctgaccctgccatccgaagtcaacctctgcaacgtggacatctttaacccgaaatacgactgcaagattatgacctccaagaccgacgtcagcagctctgtcatcactagcctgggagctattgtgtcctgctacggaaagaccaaatgcactgcctcgaacaagaacagaggcatcatcaagaccttcagcaacggctgtgactacgtgtccaacaagggagtggacaccgtgtccgtcgggaacaccctgtactacgtgaacaagcaggaggggaagtcgctctacgtcaagggggaaccgattatcaatttctacgaccccctggtgttcccttccagccagttcagtgcctccatatcccaagtcaacgagaagatcaaccagtctcttgccttcatccggaagtcggacgaactgctgtccgccatcggtggctatattccggaagcccccagggatggacaggcctacgtgcggaaggatggagaatgggtgcttttgtccaccttcctgggcggtctggtgccccgcggctcacaccatcatcaccaccacggttcgtggtcccaccctcaatttgagaagtga

SEQ ID NO: 18 - protein, 1707 aa, Artificial Sequence
  synthetic
ATGGAACTTCTGATCCTGAAAGCCAACGCGATTACCACTATCCTGACTGCCGTCACCTTCTGCTTCGCATCGGGACAGAACATTACCGAGGAGTTCTACCAGTCCACCTGTTCGGCGGTGTCCAAGGGTTACCTCTCGGCCCTGAGAACTGGCTGGTACCACAGCGTGATTACTATCGAGCTGAGCAACATCAAGGAGAACAAGTGCAATGGAACGGACGCGAAGGTCAAGCTGATTAAGCAGGAACTCGATAAGTACAAGAACGCCGTGACCGAGCTCCAGCTGCTGATGCAATCGACCCCTGCCACTAACAACAGAGCTCGCCGGGAACTGCCGCGCTTCATGAATTACACCCTCAACAACGCGAAGAAAACCAACGTGACCCTGTCCAAGAAGCGCAAGCGGAGGTTCCTGGGATTCCTGTTGGGCGTGGGCTCCGCAATCGCATCCGGAGTGGCCGTGTGTAAAGTGCTGCATCTGGAGGGGGAAGTGAACAAGATCAAGTCCGCCCTCCTGTCAACTAATAAGGCGGTGGTGTCCCTGAGCAACGGAGTCAGCGTGCTGACAATCAAGGTCCTGGACCTCAAGAACTACATCGACAAGCAGCTGTTGCCCATCGTCAACAAGCAGTCATGCTCGATTAGCAATATCGAAACCGTGATTGAGTTCCAGCAGAAGAACAACAGACTGCTCGAAATTACCCGGGAGTTTTCCGTGAACGCCGGAGTGACCACTCCTGTGTCCACCTACATGCTTACGAACTCCGAACTGCTCAGCCTCATCAACGATATGCCGATCACTAACGACCAGAAGAAGTTGATGAGCAACAATGTGCAGATCGTGCGCCAACAGTCCTACTCAATCATGTGCATTATCAAGGAGGAAATCCTCGCCTATGTGGTGCAATTGCCTCTGTACGGAGTCATCGACACACCCTGCTGGAAGCTGCACACTAGCCCACTCTGTACGACCAACACCAAGGAAGGTTCCAACATCTGCCTGACTAGGACCGATCGGGGCTGGTATTGCGATAATGCTGGGTCCGTGAGCTTCTTCCCGCAAGCCGAGACTTGCAAAGTGCAGTCAAACCGCGTGTTCTGTGACACCATGAACAGCCTGACCCTGCCATCCGAAGTCAACCTCTGCAACGTGGACATCTTTAACCCGAAATACGACTGCAAGATTATGACCTCCAAGACCGACGTCAGCAGCTCTGTCATCACTAGCCTGGGAGCTATTGTGTCCTGCTACGGAAAGACCAAATGCACTGCCTCGAACAAGAACAGAGGCATCATCAAGACCTTCAGCAACGGCTGTGACTACGTGTCCAACAAGGGAGTGGACACCGTGTCCGTCGGGAACACCCTGTACTACGTGAACAAGCAGGAGGGGAAGTCGCTCTACGTCAAGGGGGAACCGATTATCAATTTCTACGACCCCCTGGTGTTCCCTTCCGACGAGTTCGATGCCTCCATATCCCAAGTCAACGAGAAGATCAACCAGTCTCTTGCCTTCATCCGGAAGTCGGACGAACTGCTGTCCGCCATCGGTGGCTATATTCCGGAAGCCCCCAGGGATGGACAGGCCTACGTGCGGAAGGATGGAGAATGGGTGCTTTTGTCCACCTTCCTGGGCGGTCTGGTGCCCCGCGGCTCACACCATCATCACCACCACGGTTCGTGGTCCCACCCTCAATTTGAGAAGTGA

SEQ ID NO: 19 - protein, 568 aa, Artificial Sequence
  synthetic
MELLILKANAITTILTAVTFCFASGQNITEEFYQSTCSAVSKGYLSALRTGWYTSVITIELSNIKENKCNGTDAKVKLIKQELDKYKNAVTELQLLMQSTPACNNRARRELPRFMNYTLNNAKKTNVTLSKKRKRRFLGFLLGVGSACASGVAVSKVLHLEGEVNKIKSALLSTNKAVVSLSNGVSVLTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELLSAIGGYIPEAPRDGQAYVRKDGEWVLLSTFLGGLVPRGSHHHHHHGSWSHPQFEK

SEQ ID NO: 20 - protein, 568 aa, Artificial Sequence
  synthetic
MELLILKANAITTILTAVTFCFASGQNITEEFYQSTCSAVSKGYLSALRTGWYHSVITIELSNIKENKCNGTDAKVKLIKQELDKYKNAVTELQLLMQSTPACNNRARRELPRFMNYTLNNAKKTNVTLSKKRKRRFLGFLLGVGSACASGVAVSKVLHLEGEVNKIKSALLSTNKAVVSLSNGVSVLTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELLSAIGGYIPEAPRDGQAYVRKDGEWVLLSTFLGGLVPRGSHHHHHHGSWSHPQFEK

SEQ ID NO: 21 - protein, 568 aa, Artificial Sequence
  synthetic
MELLILKANAITTILTAVTFCFASGQNITEEFYQSTCSAVSKGYLSALRTGWYHCVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELLSAIGGYIPEAPRDGQAYVRKDGEWVLLSTFLGGLVPRGSHHHHHHGSWSHPQFEK

SEQ ID NO: 22 - protein, 126 aa, Artificial Sequence [sequence omitted]

SEQ ID NO: 23 - protein, 108 aa, Artificial Sequence
  synthetic
DIQMTQSPSSLSAAVGDRVTITCQASQDIVNYLNWYQQKPGKAPKLLIYVASNLETGVPSRFSGSGSGTDFSLTISSLQPEDVATYYCQQYDNLPLTFGGGTKVEIKR

SEQ ID NO: 24 - protein, 123 aa, Artificial Sequence
  synthetic
EVQLVESGGGVVQPGRSLRLSCAASGFSFSHYAMHWVRQAPGKGLEWVAVISYDGENTYYADSVKGRFSISRDNSKNTVSLQMNSLRPEDTALYYCARDRIVDDYYYYGMDVWGQGATVTVSS

SEQ ID NO: 25 - protein, 111 aa, Artificial Sequence
  synthetic
DIQMTQSPSSLSASVGDRVTITCQASQDIKKYLNWYHQKPGKVPELLMHDASNLETGVPSRFSGRGSGTDFTLTISSLQPEDIGTYYCQQYDNLPPLTFGGGTKVEIKRTV

SEQ ID NO: 26 - protein, 124 aa, Artificial Sequence
  synthetic
QVQLVQSGAEVKKPGATVKVSCKISGHTLIKLSIHWVRQAPGKGLEWMGGYEGEVDEIFYAQKFQHRLTVIADTATDTVYMELGRLTSDDTAVYFCGTLGVTVTEAGLGIDDYWGQGTLVTVSS

SEQ ID NO: 27 - protein, 108 aa, Artificial Sequence
  synthetic
EIVLTQSPGTLSLSPGERATLSCRASQIVSRNHLAWYQQKPGQAPRLLIFGASSRATGIPVRFSGSGSGTDFTLTINGLAPEDFAVYYCLSSDSSIFTFGPGTKVDFK

SEQ ID NO: 28 - protein, 124 aa, Artificial Sequence
  synthetic
EVQLVESGGGLVKPGGSLRLSCAASGFTFSSYSMNWVRQAPGKGLEWVSSISASSSYSDYADSAKGRFTISRDNAKTSLFLQMNSLRAEDTAIYFCARARATGYSSITPYFDIWGQGTLVTVSS

SEQ ID NO: 29 - protein, 110 aa, Artificial Sequence
  synthetic
QSVVTQTPSVSGAPGQRVTISCTGSSSNIGAGYDVHWYQQLPGTAPKLLIYDNNNRPSGVPDRFSASKSGTSASLAITGLQAEDEADYYCQSYDRNLSGVFGTGTKVTVL

SEQ ID NO: 30 - protein, 120 aa, Artificial Sequence
  synthetic
QVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARLYGFTYGFAYWGQGTLVTVSA

SEQ ID NO: 31 - protein, 111 aa, Artificial Sequence
  Synthetic
DIVLTQSPASLAVSLGQRATIFCRASQSVDYNGISYMHWFQQKPGQPPKLLIYAASNPESGIPARFTGSGSGTDFTLNIHPVEEEDAATYYCQQIIEDPWTFGGGTKLEIK

SEQ ID NO: 32 - protein, 568 aa, Artificial Sequence
  Synthetic
MELLILKANAITTILTAVTFCFASGQNITEEFYQSTCSAVSKGYLSALRTGWYHCVITIELSNIKENKCNGTDAKVKLIKQELDKYKNAVTELQLLMQSTPATNNRARRELPRFMNYTLNNAKKTNVTLSKKRKRRFLGFLCGVGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMCSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHGSWSHPQFEK

SEQ ID NO: 33 - protein, 568 aa, Artificial Sequence
  Synthetic
MELLILKANAITTILTAVTFCFASGQNITEEFYQSTCSAVSKGYLSALRTGWYTCVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELLSAIGGYIPEAPRDGQAYVRKDGEWVLLSTFLGGLVPRGSHHHHHHGSWSHPQFEK

SEQ ID NO: 34 - protein, 568 aa, Artificial Sequence
  Synthetic
MELLILKANAITTILTAVTFCFASGQNITEEFYQSTCSAVSKGYLSALRTGWYHCVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVCTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHGSWSHPQFEK

SEQ ID NO: 35 - protein, 568 aa, Artificial Sequence
  Synthetic
MELLILKANAITTILTAVTFCFASGQNITEEFYQSTCSAVSKGYLSALRTGWYTCVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVCTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELLSAIGGYIPEAPRDGQAYVRKDGEWVLLSTFLGGLVPRGSHHHHHHGSWSHPQFEK

SEQ ID NO: 36 - protein, 568 aa, Artificial Sequence
  Synthetic
MELLILKANAITTILTAVTFCFASGQNITEEFYQSTCSAVSKGYLSALRTGWYHCVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVCTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELLSAIGGYIPEAPRDGQAYVRKDGEWVLLSTFLGGLVPRGSHHHHHHGSWSHPQFEK

SEQ ID NO: 37 - protein, 568 aa, Artificial Sequence
  Synthetic
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELLSAIGGYIPEAPRDGQAYVRKDGEWVLLSTFLGGLVPRGSHHHHHHGSWSHPQFEK

SEQ ID NO: 38 - protein, 568 aa, Artificial Sequence
  Synthetic
MELLILKANAITTILTAVTFCFASGQNITEEFYQSTCSAVSKGYLSALRTGWYHCVITIELSNIKENKCNGTDAKVKLIKQELDKYKNAVTELQLLMQSTPATNNRARRELPRFMNYTLNNAKKTNVTLSKKRKRRFLGFLCGVGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMCSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSQFSASISQVNEKINQSLAFIRKSDELLSAIGGYIPEAPRDGQAYVRKDGEWVLLSTFLGGLVPRGSHHHHHHGSWSHPQFEK

SEQ ID NO: 39 - protein, 568 aa, Artificial Sequence
  synthetic
MELLILKANAITTILTAVTFCFASGQNITEEFYQSTCSAVSKGYLSALRTGWYHSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVCKVLHLEGEVNKIKSALLSTNKAVVSLSNGVSVLTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMCIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLSAIGGYIPEAPRDGQAYVRKDGEWVLLSTFLGGLVPRGSHHHHHHGSWSHPQFEK

SEQ ID NO: 40 - protein, 26 aa, Artificial Sequence
  Synthetic
YIPEAPRDGQAYVRKDGEWVLLSTFL

SEQ ID NO: 41 - protein, 84 aa, Artificial Sequence
  synthetic polypeptide
QNITEEFYQSTCSAVSKGYLSALRTGWYTSVITIELSNIKENKCNGTDAKVKLIKQELDKYKNAVTELQLLMQSTPACNNRARR

SEQ ID NO: 42 - protein, 377 aa, Artificial Sequence
  synthetic polypeptide
FLGFLLGVGSACASGVAVSKVLHLEGEVNKIKSALLSTNKAVVSLSNGVSVLTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELL

SEQ ID NO: 43 - protein, 84 aa, Artificial Sequence
  synthetic polypeptide
QNITEEFYQSTCSAVSKGYLSALRTGWYTSVITIELSNIKENKCNGTDAKVKLIKQELDKYKNAVTELQLLMQSTPPCNNRARR

SEQ ID NO: 44 - protein, 377 aa, Artificial Sequence
  synthetic polypeptide
FLGFLLGVGSACASGVAVSKVLHLEGEVNKIKSALLSTNKAVVSLSNGVSVLTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEINLCNVDIFNPKYDCKIMTSKTDVSSSVITSLGAIVSCYGKTKCTASNKNRGIIKTFSNGCDYVSNKGMDTVSVGNTLYYVNKQEGKSLYVKGEPIINFYDPLVFPSSEFDASISQVNEKINQSLAFIRKSDELL

SEQ ID NO: 45 - protein, 84 aa, Artificial Sequence
  synthetic polypeptide
QNITEEFYQSTCSAVSKGYLSALRTGWYTSVITIELSNIKENKCNGTDAKVKLIKQELDKYKNAVTELQLLMQSTPACNSRARR

SEQ ID NO: 46 - protein, 377 aa, Artificial Sequence
  synthetic polypeptide
FLGFLLGVGSACASGIAVSKVLHLEGEVNKIKSALLSTNKAVVSLSNGVSVLTIKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELL

SEQ ID NO: 47 - protein, 84 aa, Artificial Sequence
  synthetic polypeptide
QNITEEFYQSTCSAVSRGYFSALRTGWYTSVITIELSNIKETKCNGTDTKVKLIKQELDKYKNAVTELQLLMQNTPACNNRARR

SEQ ID NO: 48 - protein, 377 aa, Artificial Sequence
  synthetic polypeptide
FLGFLLGVGSACASGIAVSKVLHLEGEVNKIKNALLSTNKAVVSLSNGVSVLTIKVLDLKNYINNRLLPIVNQQSCRISNIETVIEFQQMNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 49 - protein, 84 aa, Artificial Sequence; identical to SEQ ID NO: 47
  synthetic polypeptide

SEQ ID NO: 50 - protein, 377 aa, Artificial Sequence
  synthetic polypeptide
FLGFLLGVGSACASGIAVSKVLHLEGEVNKIKNALLSTNKAVVSLSNGVSVLTIKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 51 - protein, 84 aa, Artificial Sequence
  synthetic polypeptide
QNITEEFYQSTCSAVSKGYLSALRTGWYHSVITIELSNIKENKCNGTDAKVKLIKQELDKYKNAVTELQLLMQSTPACNNRARR

SEQ ID NO: 52 - protein, 377 aa, Artificial Sequence
  synthetic polypeptide
FLGFLLGVGSACASGVAVSKVLHLEGEVNKIKSALLSTNKAVVSLSNGVSVLTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELL

SEQ ID NO: 53 - protein, 84 aa, Artificial Sequence
  synthetic polypeptide
QNITEEFYQSTCSAVSKGYLSALRTGWYHSVITIELSNIKENKCNGTDAKVKLIKQELDKYKNAVTELQLLMQSTPPCNNRARR

SEQ ID NO: 54 - protein, 377 aa, Artificial Sequence
  synthetic polypeptide
FLGFLLGVGSACASGVAVSKVLHLEGEVNKIKSALLSTNKAVVSLSNGVSVLTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEINLCNVDIFNPKYDCKIMTSKTDVSSSVITSLGAIVSCYGKTKCTASNKNRGIIKTFSNGCDYVSNKGMDTVSVGNTLYYVNKQEGKSLYVKGEPIINFYDPLVFPSSEFDASISQVNEKINQSLAFIRKSDELL

SEQ ID NO: 55 - protein, 84 aa, Artificial Sequence
  synthetic polypeptide
QNITEEFYQSTCSAVSKGYLSALRTGWYHSVITIELSNIKENKCNGTDAKVKLIKQELDKYKNAVTELQLLMQSTPACNSRARR

SEQ ID NO: 56 - protein, 377 aa, Artificial Sequence
  synthetic polypeptide
FLGFLLGVGSACASGIAVSKVLHLEGEVNKIKSALLSTNKAVVSLSNGVSVLTIKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELL

SEQ ID NO: 57 - protein, 84 aa, Artificial Sequence
  synthetic polypeptide
QNITEEFYQSTCSAVSRGYFSALRTGWYHSVITIELSNIKETKCNGTDTKVKLIKQELDKYKNAVTELQLLMQNTPACNNRARR

SEQ ID NO: 58 - protein, 377 aa, Artificial Sequence
  synthetic polypeptide
FLGFLLGVGSACASGIAVSKVLHLEGEVNKIKNALLSTNKAVVSLSNGVSVLTIKVLDLKNYINNRLLPIVNQQSCRISNIETVIEFQQMNSRLLEITREFSVNAGVTTPLSTYMLTNSELLSLINDMPITNDQKKLMSSNVQIVRQQSYSIMSIIKEEILAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 59 - protein, 84 aa, Artificial Sequence; identical to SEQ ID NO: 57
  synthetic polypeptide

SEQ ID NO: 60 - protein, 377 aa, Artificial Sequence
  synthetic polypeptide
FLGFLLGVGSACASGIAVSKVLHLEGEVNKIKNALLSTNKAVVSLSNGVSVLTIKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEILAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 61 - protein, 84 aa, Artificial Sequence
  synthetic polypeptide
QNITEEFYQSTCSAVSKGYLSALRTGWYHCVITIELSNIKENKCNGTDAKVKLIKQELDKYKNAVTELQLLMQSTPATNNRARR

SEQ ID NO: 62 - protein, 377 aa, Artificial Sequence
  synthetic polypeptide
FLGFLLGVGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELL

SEQ ID NO: 63 - protein, 84 aa, Artificial Sequence
  synthetic polypeptide
QNITEEFYQSTCSAVSKGYLSALRTGWYHCVITIELSNIKENKCNGTDAKVKLIKQELDKYKNAVTELQLLMQSTPPTNNRARR

SEQ ID NO: 64 - protein, 377 aa, Artificial Sequence
  synthetic polypeptide
FLGFLLGVGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEINLCNVDIFNPKYDCKIMTSKTDVSSSVITSLGAIVSCYGKTKCTASNKNRGIIKTFSNGCDYVSNKGMDTVSVGNTLYYVNKQEGKSLYVKGEPIINFYDPLVFPSSEFDASISQVNEKINQSLAFIRKSDELL

SEQ ID NO: 65 - protein, 84 aa, Artificial Sequence
  synthetic polypeptide
QNITEEFYQSTCSAVSKGYLSALRTGWYHCVITIELSNIKENKCNGTDAKVKLIKQELDKYKNAVTELQLLMQSTPAANSRARR

SEQ ID NO: 66 - protein, 377 aa, Artificial Sequence
  synthetic polypeptide
FLGFLLGVGSAIASGIAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELL

SEQ ID NO: 67 - protein, 84 aa, Artificial Sequence
  synthetic polypeptide
QNITEEFYQSTCSAVSRGYFSALRTGWYHCVITIELSNIKETKCNGTDTKVKLIKQELDKYKNAVTELQLLMQNTPAANNRARR

SEQ ID NO: 68 - protein, 377 aa, Artificial Sequence
  synthetic polypeptide
FLGFLLGVGSAIASGIAVSKVLHLEGEVNKIKNALLSTNKAVVSLSNGVSVCTSKVLDLKNYINNRLLPIVNQQSCRISNIETVIEFQQMNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 69 - protein, 84 aa, Artificial Sequence; identical to SEQ ID NO: 67
  synthetic polypeptide

SEQ ID NO: 70 - protein, 377 aa, Artificial Sequence
  synthetic polypeptide
FLGFLLGVGSAIASGIAVSKVLHLEGEVNKIKNALLSTNKAVVSLSNGVSVCTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 71 - protein, 84 aa, Artificial Sequence; identical to SEQ ID NO: 61
  synthetic polypeptide

SEQ ID NO: 72 - protein, 377 aa, Artificial Sequence
  synthetic polypeptide
FLGFLLGVGSAIASGVAVSKVLHLEGEVNKIKSALLSTNKAVVSLSNGVSVCTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELL

SEQ ID NO: 73 - protein, 84 aa, Artificial Sequence; identical to SEQ ID NO: 63
  synthetic polypeptide

SEQ ID NO: 74 - protein, 377 aa, Artificial Sequence
  synthetic polypeptide
FLGFLLGVGSAIASGVAVSKVLHLEGEVNKIKSALLSTNKAVVSLSNGVSVCTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEINLCNVDIFNPKYDCKIMTSKTDVSSSVITSLGAIVSCYGKTKCTASNKNRGIIKTFSNGCDYVSNKGMDTVSVGNTLYYVNKQEGKSLYVKGEPIINFYDPLVFPSSEFDASISQVNEKINQSLAFIRKSDELL

SEQ ID NO: 75 - protein, 84 aa, Artificial Sequence; identical to SEQ ID NO: 65
  synthetic polypeptide

SEQ ID NO: 76 - protein, 377 aa, Artificial Sequence
  synthetic polypeptide
FLGFLLGVGSAIASGIAVSKVLHLEGEVNKIKSALLSTNKAVVSLSNGVSVCTIKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELL

SEQ ID NO: 77 - protein, 84 aa, Artificial Sequence; identical to SEQ ID NO: 67
  synthetic polypeptide

SEQ ID NO: 78 - protein, 377 aa, Artificial Sequence
  synthetic polypeptide
FLGFLLGVGSAIASGIAVSKVLHLEGEVNKIKNALLSTNKAVVSLSNGVSVCTIKVLDLKNYINNRLLPIVNQQSCRISNIETVIEFQQMNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 79 - protein, 84 aa, Artificial Sequence; identical to SEQ ID NO: 67
  synthetic polypeptide

SEQ ID NO: 80 - protein, 377 aa, Artificial Sequence
  synthetic polypeptide
FLGFLLGVGSAIASGIAVSKVLHLEGEVNKIKNALLSTNKAVVSLSNGVSVCTIKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 81 - protein, 574 aa, Human respiratory syncytial virus
  F protein of human RSV subtype A/ABI35685
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKADVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 82 - protein, 573 aa, Human respiratory syncytial virus
  F protein of human RSV subtype A/AAS93651
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFS

SEQ ID NO: 83 - protein, 574 aa, Human respiratory syncytial virus
  F protein of human RSV subtype A/AEO45830
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 84 - protein, 574 aa, Human respiratory syncytial virus
  F protein of human RSV subtype A/AFM55244
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 85 - protein, 574 aa, Human respiratory syncytial virus
  F protein of human RSV subtype A/AFM55442
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKEQLSGINNIAFSN

SEQ ID NO: 86 - protein, 574 aa, Human respiratory syncytial virus
  F protein of human RSV subtype A/AFM55255
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTINTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYFKARSTPVTLSKDQLSGINNIAFSN

SEQ ID NO: 87 - protein, 574 aa, Human respiratory syncytial virus
  F protein of human RSV subtype A/AFM55288
MDLPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTINTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 88 - protein, 574 aa, Human respiratory syncytial virus
  F protein of human RSV subtype A/AFM95385
  misc_feature (91)..(91): Xaa can be any naturally occurring amino acid
  misc_feature (363)..(363): Xaa can be any naturally occurring amino acid
MELPILKTNAITTILAAVTLCFASSQNITEEFYQSTCSAVSKGYLSALRTGWYTSVITIELSNIKENKCNGTDAKVKLIKQELDKYKNAVXELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSXRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 89 - protein, 574 aa, Human respiratory syncytial virus
  F protein of human RSV subtype A/AFM95400
MELPILKTNAITTILAAVTLCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKNNNVTLSNKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 90 - protein, 574 aa, Human respiratory syncytial virus
  F protein of human RSV subtype A/AAM68157
MDLPILKTNAITTILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 91 - protein, 574 aa, Human respiratory syncytial virus
  F protein of human RSV subtype A/AAM68160
MDLPILKTNAITTILAAVLLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 92 - protein, 574 aa, Human respiratory syncytial virus
  F protein of human RSV subtype A/AEO45859
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 93 - protein, 574 aa, Human respiratory syncytial virus
  F protein of human RSV subtype A/AEQ63444
MDLPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 94 - protein, 569 aa, Human respiratory syncytial virus
  F protein of human RSV subtype A/AEQ98752
MDLPILKTNAITAILAVVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNITLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINN

SEQ ID NO: 95 - protein, 574 aa, Human respiratory syncytial virus
  F protein of human RSV subtype A/AFM55299
MDLPILKTKAITTILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNNKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTLSKDQLSGINNIAFSN

SEQ ID NO: 96 - protein, 574 aa, Human respiratory syncytial virus
  F protein of human RSV subtype A/AEO45850
MELPILKTNAITTILTAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLLLYCKARSTPVTLSKDQLSGINNIAFSN

SEQ ID NO: 97 - protein, 574 aa, Human respiratory syncytial virus
  F protein of human RSV subtype A/AEO45869
MELPILKTNAITAILAAVSLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLLLYCKARSTPVTLSKDQLSGINNIAFSN

SEQ ID NO: 98 - protein, 574 aa, Human respiratory syncytial virus
  F protein of human RSV subtype A/AEO45879
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 99 - protein, 574 aa, Human respiratory syncytial virus
  F protein of human RSV subtype A/AEO45909
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLLLYCKARSTPVTVINDQLSGINNIAFSN

SEQ ID NO: 100 - protein, 574 aa, Human respiratory syncytial virus
  F protein of human RSV subtype A/AAM68154
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSRKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSISFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLCVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 101 - protein, 574 aa, Human respiratory syncytial virus
  F protein of human RSV subtype A/ADZ95777
  misc_feature (272)..(272): Xaa can be any naturally occurring amino acid
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTANVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKXLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 102 - protein, 574 aa, Human respiratory syncytial virus
  F protein of human RSV subtype A/AEC32087
MELPILKTNAITTILAAVTLCFASSQNITEEFYQSTCSAVSKGYLSALRTGWYTSVITIELSNIKENKCNGTDAKVKLIKQELDKYKNAVTELQLLMQSTQAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 103 - protein, 574 aa, Human respiratory syncytial virus
  F protein of human RSV subtype A/AEO45929
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 104 - protein, 574 aa, Human respiratory syncytial virus
  F protein of human RSV subtype A/AFM55211
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSRKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 105 - protein, 574 aa, Human respiratory syncytial virus
  F protein of human RSV subtype A/AFM55222
MELPILKTNVITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 106 - protein, 574 aa, Human respiratory syncytial virus
  F protein of human RSV subtype A/AFM55332
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPATNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 107 - protein, 573 aa, Human respiratory syncytial virus
  F protein of human RSV subtype A/AAS93649
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFS

SEQ ID NO: 108 - protein, 574 aa, Human respiratory syncytial virus
  F protein of human RSV subtype A/ADZ95778
MELPILKTNAITTILAAVTLCFASSQNITEEFYQSTCSAVSKGYLSALRTGWYTSVITIELSSIKENKCNGTDAKVKLIKQELDKYKNAVTELQLLMQSTPAANNRARRELPRFMNYTLNNTKTTNVTLSRKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMFNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 109 - protein, 574 aa, Human respiratory syncytial virus
  F protein of human RSV subtype A/AFM55420
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSRKRKRRFLGFLLGVGSAIASGIAVSKVLHLEGEVNKIKSALLSTNKAVVSLSNGVSVLTSKVLDLKNYIDKQLLPVVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 110 - protein, 574 aa, Human respiratory syncytial virus
  F protein of human RSV subtype A/AEO45840
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCKARSTPVTVSKDQLSGINNIAFSN

SEQ ID NO: 111 - protein, 574 aa, Human respiratory syncytial virus
  F protein of human RSV subtype A/AEO45949
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCKARSTPVTLSKDQLSGINNIAFSS

SEQ ID NO: 112 - protein, 574 aa, Human respiratory syncytial virus
  F protein of human RSV subtype A/1701388A
MELPILKTNTITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAVKSTTNIMITTIIIVIIVILLSLIAVGLLLYCKARSTPVTLSKDQLSGINNIAFSN

SEQ ID NO: 113 - protein, 574 aa, Human respiratory syncytial virus
  F protein of human RSV subtype A/AEQ63487
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPNEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 114 - protein, 574 aa, Human respiratory syncytial virus
  F protein of human RSV subtype A/AEQ63520
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 115 - protein, 573 aa, Human respiratory syncytial virus
  F protein of human RSV subtype A/AAS93653
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFS

SEQ ID NO: 116 - protein, 574 aa, Human respiratory syncytial virus
  F protein of human RSV subtype A/AFM95365
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKYDELLHNVNAGKSTTNIMITTIIIVIIVILLSLIAVGLLLYCKARSTPVTLSKDQLSGINNIAFSN

SEQ ID NO: 117 - protein, 574 aa, Human respiratory syncytial virus
  F protein of human RSV subtype A/AFM95376
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSNEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 118 - protein, 574 aa, Human respiratory syncytial virus
  F protein of human RSV subtype A/AEQ63312
MELPVLKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 119 - protein, 574 aa, Human respiratory syncytial virus
  F protein of human RSV subtype A/AEO23051
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 120 - protein, 574 aa, Human respiratory syncytial virus
  F protein of human RSV subtype A/AEQ63334
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 121 - protein, 574 aa, Human respiratory syncytial virus
  F protein of human RSV subtype A/AEQ63367
  misc_feature (32)..(32): Xaa can be any naturally occurring amino acid
MELPILKTNAITTILAAVTLCFASSQNITEEXYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 122 - protein, 574 aa, Human respiratory syncytial virus
  F protein of human RSV subtype A/AFM55563
MELPILKTNAITTILAAVTLCFASSQNITEEFYQSTCSAVSKGYLSALRTGWYTSVITIELSNIKENKCNGTDAKVKLIKQELDKYKNAVTELQLLMQSTQAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 123 - protein, 574 aa, Human respiratory syncytial virus
  F protein of human RSV subtype A/AFM55552
MELPILNTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 124 - protein, 574 aa, Human respiratory syncytial virus
  F protein of human RSV subtype A/AFX60137
MELPILNTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNKKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 125 - protein, 574 aa, Human respiratory syncytial virus
  F protein of human RSV subtype A/AFX60173
MELPILNTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTSIMITTIIIVIIVILLSLIAVGLLLYCKARSTPVTLSKDQLSGINNIAFSN

SEQ ID NO: 126 - protein, 574 aa, Human respiratory syncytial virus
  F protein of human RSV subtype A/AFM55365
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKIHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 127 - protein, 574 aa, Human respiratory syncytial virus
  F protein of human RSV subtype A/AAO72323
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIATVIEFQQKNNRLLEITREFSVNAGVTTPVSTYMLTNSELLSLINDMPITNDQKKLMSNNVQIVRQQSYSIMSIIKEEVLAYVVQLPLYGVMDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTINIMITTIIIVIIVILLSLIAVGLLLYCKARSTPVTLSKDQLSGINNIAFSN

SEQ ID NO: 128 - protein, 574 aa, Human respiratory syncytial virus
  F protein of human RSV subtype A/AAO72324
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIATVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPFDEFDASISQVNEKINQSLAFIRKSDELLHNVNAGKSTINIMITTIIIVIIVILLSLIAVGLLLYCKARSTPVTLSKDQLSGINNIAFSN

SEQ ID NO: 129 - protein, 574 aa, Human respiratory syncytial virus
  F protein of human RSV subtype A/ACY68435
MELPILKTNAITTILAAVTLCFASSQNITEEFYQSTCSAVSKGYLSALRTGWYTSVITIELSTIKENKCNGTDAKVKLIKQELDKYKNAVTELQLLMQSTPAANNRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 130 - protein, 574 aa, Human respiratory syncytial virus
  F protein of human RSV subtype A/AEC32085
MELPILKTNAITTILAAVTLCFASSQNITEEFYQSTCSAVSKGYLSALRTGWYTSVITIELSTIKENKCNGTDAKGKLIKQELDKYKNAVTELQLLMQSTPAANNRARRELPRFMNYTLNNAKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTKIMITTIIIVIIVILLSLIAVGLLLYCKARSTPVTLSKDQLSGINNIAFSS

SEQ ID NO: 131 - protein, 574 aa, Human respiratory syncytial virus
  F protein of human RSV subtype A/AFM55266
MELPILKTNAITTILAAVTFCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKARSTPVTLSKDQLSGINNIAFSS

SEQ ID NO: 132 - protein, 574 aa, Human respiratory syncytial virus
  F protein of human RSV subtype A/AFM55277
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNSKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKARSTPVTLSKDQLSGINNIAFSS

SEQ ID NO: 133 - protein, 574 aa, Human respiratory syncytial virus
  F protein of human RSV subtype A/AFM55354
MELPILKTNAITTILAAVTLCFVSSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIVVILLSLIAVGLLLYCKARSTPVTLSKDQLSGINNIAFSS

SEQ ID NO: 134 - protein, 565 aa, Human respiratory syncytial virus
  F protein of human RSV subtype A/AEO12131
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQTVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKIDQSLAFIRKSDELLHNVNAGKSTTNIMITTIIIVIIVILLALIAVGLLLYCKARSTPVTLSKDQLR

SEQ ID NO: 135 - protein, 574 aa, Human respiratory syncytial virus
  F protein of human RSV subtype A/AEO23052
MELPILKANAISTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 136 - protein, 574 aa, Human respiratory syncytial virus; identical to SEQ ID NO: 4
  F protein of human RSV subtype A/AEQ63389

SEQ ID NO: 137 - protein, 569 aa, Human respiratory syncytial virus
  F protein of human RSV subtype A/AEQ98748
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINN

SEQ ID NO: 138 - protein, 569 aa, Human respiratory syncytial virus
  F protein of human RSV subtype A/AEQ98747
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVITVILLALIAVGLLLYCKARSTPVTLSKDQLSGINN

SEQ ID NO: 139 - protein, 569 aa, Human respiratory syncytial virus
  F protein of human RSV subtype A/AEQ98749
MELPILKTNAITTILAAVTFCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINN

SEQ ID NO: 140 - protein, 569 aa, Human respiratory syncytial virus
  F protein of human RSV subtype A/AEQ98753
MELPILKTNAITTILAAVILCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINN

SEQ ID NO: 141 - protein, 569 aa, Human respiratory syncytial virus
  F protein of human RSV subtype A/AEQ98755
MELPILKTNAITTILAAVTLCFASSQNITEEFYQSTCSAVSKGYLSALRTGWYTSVIAIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINN

SEQ ID NO: 142 - protein, 569 aa, Human respiratory syncytial virus
  F protein of human RSV subtype A/AEQ98757
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPISTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINN

SEQ ID NO: 143 - protein, 574 aa, Human respiratory syncytial virus
  F protein of human RSV subtype A/AFV46409
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDTSISQVNEKINQSLAFIRKSDELLHNVNAGKSTTNIMITTIIIVIIVILLALIAVGLLLYCKARSTPVTLSKDQLSGINNIAFSN

SEQ ID NO: 144 - protein, 574 aa, Human respiratory syncytial virus
  F protein of human RSV subtype A/AFV46417
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRTRRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 145 - protein, 574 aa, Human respiratory syncytial virus
  F protein of human RSV subtype A/AFX60128
MELPILKTNAITTILAAVTLCFTSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 146 - protein, 574 aa, Human respiratory syncytial virus
  F protein of human RSV subtype A/AFX60187
MELPILKTNAITTILAAVTLCFSSSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 147 - protein, 574 aa, Human respiratory syncytial virus
  F protein of human RSV subtype A/AFX60129
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNITLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 148 - protein, 574 aa, Human respiratory syncytial virus
  F protein of human RSV subtype A/AFX60135
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGTAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 149 - protein, 574 aa, Human respiratory syncytial virus
  F protein of human RSV subtype A/AFX60141
  misc_feature (292)..(292): Xaa can be any naturally occurring amino acid
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIXKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 150 - protein, 574 aa, Human respiratory syncytial virus
  F protein of human RSV subtype A/AFX60148
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISLVNEKINQSLAFIRKSDELLHNVNAGKSTTNIMITTIIIVIIVILLALIAVGLLLYCKARSTPVTLSKDQLSGINNIAFSN

SEQ ID NO: 151 - protein, 574 aa, Human respiratory syncytial virus
  F protein of human RSV subtype A/AFX60151
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSILNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 152 - protein, 574 aa, Human respiratory syncytial virus
  F protein of human RSV subtype A/AFX60169
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPSANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 153 - protein, 574 aa, Human respiratory syncytial virus
  F protein of human RSV subtype A/AFX60200
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKVGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 154 - protein, 574 aa, Human respiratory syncytial virus
  F protein of human RSV subtype A/AFX60201
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLALIAVGLLLYCKARSTPVTLSKDQLSGINNIAFSN

SEQ ID NO: 155 - protein, 574 aa, Human respiratory syncytial virus
  F protein of human RSV subtype A/AFM55343
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNANVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 156 - protein, 574 aa, Human respiratory syncytial virus
  F protein of human RSV subtype A/AFV46401
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNINVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 157 - protein, 574 aa, Human respiratory syncytial virus
  F protein of human RSV subtype A/AFV46410
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPTANSRARRELPRFMNYTLNNTKNINVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 158 - protein, 569 aa, Human respiratory syncytial virus
  F protein of human RSV subtype A/AEQ98756
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNIKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINN

SEQ ID NO: 159 - protein, 574 aa, Human respiratory syncytial virus
  F protein of human RSV subtype A/AFV46403
MELPILKTNAITTILAAVTLCFASSQNITEEFYQSTCSAVSKGYLSALRTGWYTSVITIELSNIKENKCNGTDAKVKLIKQELDKYKNAVTELQLLMQSTSAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNIKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 160 - protein, 574 aa, Human respiratory syncytial virus
  F protein of human RSV subtype A/AFX60202
MELPILKTNAITTILAAVTLCFASSQNITEEFYQSTCSAVSKGYLSALRTGWYTSVITIELSNIKENKCNGTDAKVKLIKQELDKYKNAVTELQLLMQSTSAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 161 - protein, 574 aa, Human respiratory syncytial virus
  F protein of human RSV subtype A/AFV46413
MELPILKTNAITTILAAITLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 162 - protein, 574 aa, Human respiratory syncytial virus
  F protein of human RSV subtype A/AFV46414
MELPILKTNAITTILAAITLCFASSQNITEEFYQSTCSAVSKGYLSALRTGWYTSVITIELSNIKENKCNGTDAKVKLIKQELDKYKNAVIELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 163 - protein, 574 aa, Human respiratory syncytial virus
  F protein of human RSV subtype A/AFX60208
MELPILKTNAITTILAAVTLCFASSQNITEEFYQSTCSAVSKGYLSALRTGWYTSVITIELSNIKENKCNGTDAKVKLIKQELDKYKNAVIELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 164 - protein, 574 aa, Human respiratory syncytial virus
  F protein of human RSV subtype A/AFV46419
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICITRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 165 - protein, 574 aa, Human respiratory syncytial virus
  F protein of human RSV subtype A/AFV46420
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICITRTDRGWYCDNAGSVSFFPQAETCKVQSNRVFCDTMNSLTLPSEVNFCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 166 - protein, 574 aa, Human respiratory syncytial virus
  F protein of human RSV subtype A/AFX60138
MELPILKTNSITTILAAVTLCFASSQNITEEFYQSTCSAVSKGYLSALRTGWYTSVITIELSNIKENKCNGTDTKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 167 - protein, 574 aa, Human respiratory syncytial virus
  F protein of human RSV subtype A/AFX60150
MELPILKTNAITTILAAVTLCFASSQNITEEFYQSTCSAVSKGYLSALRTGWYTSVITIELSNIKENKCNGTDTKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 168 - protein, 574 aa, Human respiratory syncytial virus
  F protein of human RSV subtype A/AFX60162
MELPILKTNAITTILAAVTLCFASSQNITEEFYQSTCSAVSKGYLSALRTGWYTSVITIELSNIKENKCNGTDAKVKLIKQELDKYKNAVTELQLFMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTINTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 169 - protein, 574 aa, Human respiratory syncytial virus
  F protein of human RSV subtype A/AFX60190
MELPILKTNAITTILAAVTLCFASSQNITEEFYQSTCSAVSKGYLSALRTGWYTSVITIELSNIKENKCNGTDAKVKLIKQELDKYKNAVTELQLFMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 170 - protein, 574 aa, Human respiratory syncytial virus
  F protein of human RSV subtype A/AFX95851
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLGKDQLSGINNIAFNN

SEQ ID NO: 171 - protein, 574 aa, Human respiratory syncytial virus
  F protein of human RSV subtype A/AFM55387
MELPILKTNAITIILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSAPVTLSKDQLSGINNIAFSN

SEQ ID NO: 172 - protein, 574 aa, Human respiratory syncytial virus
  F protein of human RSV subtype A/AFM55530
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANSRARRELPRFMNYTLNSTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQINEKINQSLAFIRKSDELLHNVNAGKSTTNIMITTIIIVIIVILLALIAVGLLLYCKARSTPVTLSKDQLSGINNIAFSN

SEQ ID NO: 173 - protein, 574 aa, Human respiratory syncytial virus
  F protein of human RSV subtype A/AEO45919
MELPILKINAITTILAAITLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTVSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCKARSTPVTLSKDQLSGINNIAFSN

SEQ ID NO: 174 - protein, 573 aa, Human respiratory syncytial virus
  F protein of human RSV subtype A/AAS93655
MELPILKTNAITTILAAATLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCENAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCKARSTPVTLSKDQLSGINNIAFS

SEQ ID NO: 175 - protein, 573 aa, Human respiratory syncytial virus
  F protein of human RSV subtype A/AAS93656
MELPILKTNAITTILAAAILCFTSSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCRARSTPVTLSKDQLSGINNIAFS

SEQ ID NO: 176 - protein, 574 aa, Human respiratory syncytial virus
  F protein of human RSV subtype A/AEO45939
MDLPILKTNAITTILAAVTLCFASSQNITEEFYQSTCSAVSKGYLSALRTGWYTSVITIELSNIKENKCNGTDAKVKLIKQELDKYKNAVTELQLLMQSTPASNNRARRELPRFMNYTLNNTKNTNVTLSKKRKRRFLGFLLGVGSAIASGIAVSKVLHLEGEVNKIKSALLSTNKAVVSFIDGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLSLIAVGLLLYCKARSTPVTLSKDQLSGINNIAFSN

SEQ ID NO: 177 - protein, 574 aa, Human respiratory syncytial virus
  F protein of human RSV subtype A/P11209
MELPILKTNAITAILAAVTLCFASSQNITEEFYQSTCSAVSKGYLSALRTGWYTSVITIELSNIKENKCNGTDAKVKLIKQELDKYKSAVTELQLLMQSTPATNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKDRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 178 - protein, 574 aa, Human respiratory syncytial virus
  F protein of human RSV subtype A/AAC57027
MELPILKTNAITAILAAVTLCFASSQNITEEFYQSTCSAVSKGYLSALRTGWYTSVITIELSNIKENKCNGTDAKVKLIKQELDKYKSAVTELQLLMQSTPATNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 179 - protein, 574 aa, Human respiratory syncytial virus
  F protein of human RSV subtype A/NP_044596
MELPILKTNAITAILAAVTLCFASSQNITEEFYQTTCSAVSKGYLSALRTGWYTSVITIELSNIKENKCNGTDAKVKLIKQELDKYKSAVTELQLLMQSTPATNNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPLAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTINIMITTIIIVIIVILLSLIAVGLLLYCKARSTPVTLSKDQLSGINNIAFSN

SEQ ID NO: 180 - protein, 574 aa, Human respiratory syncytial virus
  F protein of human RSV subtype A/AAM44851
MELPILKANAITTILAAVTLCFVSSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 181 - protein, 574 aa, Human respiratory syncytial virus
  F protein of human RSV subtype A/AFX60127
MELPILKANAITTILTAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNAGKSTTNIMITTIIIVIVVILLSLIVVGLLLYCKARSTPVTLSKDQLSGINNIAFSS

SEQ ID NO: 182 - protein, 574 aa, Human respiratory syncytial virus
  F protein of human RSV subtype A/AFX60156
MELPILKANAITTILAAVILCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKNALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKNLYVKGEPIINFYDPLVFPSDEFDASISQVNEKINQSLAFIRKSDELLHNVNAGKSTTNIMITTIIIVIVVILLSLIVVGLLLYCKARSTPVTLSKDQLSGINNIAFSS

SEQ ID NO: 183 - protein, 574 aa, Human respiratory syncytial virus
  F protein of human RSV subtype A/AAO72325
MELPILKTNAITTILAAVTLCFASSQNITEEFYQSTCSAVSKGYLSALRTGWYTSVITIELSNIKENKCNGTDAKAKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLHLKNYIDKQFLPIVNKQSCSISNIATVIEFQQKNNRLLEITREFSVNAGVTTPVSTYMLTNSELLSLINDMPITNDQKKLMSNNVQIVRQQSYSIMSIIKEEVLAYVVQLPLYGVMDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTINIMITTIIIVIIVILLSLIAVGLLLYCKARSTPVTLSKDQLSGINNIAFSS

SEQ ID NO: 184 - protein, 574 aa, Human respiratory syncytial virus
  F protein of human RSV subtype A/P12568
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYASNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 185 - protein, 574 aa, Human respiratory syncytial virus
  F protein of human RSV subtype A/1512372A
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVDKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYASNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 186 - protein, 574 aa, Human respiratory syncytial virus
  F protein of human RSV subtype A/AAQ97026
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYGCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 187 - protein, 574 aa, Human respiratory syncytial virus
  F protein of human RSV subtype A/AAQ97031
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 188 - protein, 574 aa, Human respiratory syncytial virus
  F protein of human RSV subtype A/AAQ97027
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCRIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 189 - protein, 574 aa, Human respiratory syncytial virus
  F protein of human RSV subtype A/AAQ97028
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGFLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFEASISQVNEKINQSLAFIRKSDELLHHVNAGKSTTNIMITTIIIVIIVILLSLIAVGLLLYCKARSTPVTLSKDQLSGINNIAFSN

SEQ ID NO: 190 - protein, 574 aa, Human respiratory syncytial virus
  F protein of human RSV subtype A/AAQ97029
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGLLLGVGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 191 - protein, 574 aa, Human respiratory syncytial virus
  F protein of human RSV subtype A/AAQ97030
MELPILKANAITTILAAVTFCFASSQNITEEFYQSTCSAVSKGYLSALRTGWYTSVITIELSNIKENKCNGTDAKVKLIKQELDKYKNAVTELQLLMQSTSAANNRARRELPRFMNYTLNNTKKTNVTLSKKRKRRFLGFLLGAGSAIASGTAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 192 - protein, 574 aa, Human respiratory syncytial virus
  F protein of human RSV subtype A/ABQ42594
MELPILKANAITTILAAVTFCFASSQNITEEFYQSTCSAVSKGYLSALRTGWYTSVITIELSNIKENKCNGTDAKVKLMKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNVGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 193 - protein, 574 aa, Human respiratory syncytial virus
  F protein of human RSV subtype A/CAA81295
MELPILKANAITTILAAVTFCFASSQNITEEFYQSTCSAVSKGYLSALRTGWYTSVITIELSNIKENKCNGTDAKVKLMKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 194 - protein, 574 aa, Human respiratory syncytial virus
  F protein of human RSV subtype A/ACO83302
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 195 - protein, 574 aa, Human respiratory syncytial virus
  F protein of human RSV subtype A/ADZ95781
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKNLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 196 - protein, 574 aa, Human respiratory syncytial virus
  F protein of human RSV subtype A/ADZ95782
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKMLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 197 - protein, 574 aa, Human respiratory syncytial virus
  F protein of human RSV subtype A/ADZ95783
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKTLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 198 - protein, 574 aa, Human respiratory syncytial virus
  F protein of human RSV subtype A/ADZ95784
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKQLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 199 - protein, 574 aa, Human respiratory syncytial virus
  F protein of human RSV subtype A/ADZ95785
MELPILKANAITTILAAVTFCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKELMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 200 - protein, 574 aa, Human respiratory syncytial virus
  F protein of human RSV subtype A/AAX23994
MELPILKANAITTILAAVTFCFASSQNITEEFYQSTCSAVSKGYLSALRTGWYTSVITIELSNIKENKCNGTDAKVKLINQELDKYKNAVTELQLLMQSTTAANNRARRELPRFMNYTLNNTKKTNVTLSKKRKRRFLGFLLGVGSAIASGIAVSKVLHLEGEVNKIKSALLSTNKAVVSLSNGVSVLTSKVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHHVNAGKSTTNIMITTIIIVIIVILLSLIAVGLLLYCKARSTPVTLSKDQLSGINNIAFSN

SEQ ID NO: 201 - protein, 574 aa, Human respiratory syncytial virus
  F protein of human RSV subtype A/ACO83297
MELPILKANAITTILAAVTFCFASSQNITEEFYQSTCSAVSKGYLSALRTGWYTSVITIELSNIKKNKCNGTDAKVKLMKQELDKYKNAVTELQLLMQSTPAANNRARRELPRFMNYTLNNTKKTNVTLSKKRKRRFLGFLLGVGSAIASGIAVSKVLHLEGEVNKIKSALLSTNKAVVSLSNGVSVLTSRVLDLKNYIDKQLLPIVNKQSCRISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAEKCKVQSNRVFCDTMYSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPITLSKDQLSGINNIAFSN

SEQ ID NO: 202 - protein, 574 aa, Human respiratory syncytial virus
  F protein of human RSV subtype A/AEQ63378
  misc_feature (428)..(435): Xaa can be any naturally occurring amino acid
MELPILKTNAITTILAAVTLCFASSQNITEEFYQSTCSAVSKGYLSALRTGWYTSVITIELSNIKENKCNGTDAKVKLIKQELDKYKNAVTELQLLMQSAPAANSRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSSNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKXXXXXXXXSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLALIAVGLLLYCKARSTPVTLSKDQLSGINNIAFSN

SEQ ID NO: 203 - protein, 574 aa, Human respiratory syncytial virus
  F protein of human RSV subtype A/AEO45889
MELPILKTNAITTIFAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKNNNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNVGKSTTNIMITTIIIVIIVILLLLIAVGLFLYCKARSTPVTVIDDYLSGINNISFIY

SEQ ID NO: 204 - protein, 574 aa, Human respiratory syncytial virus
  F protein of human RSV subtype A/AAC55970
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIATVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTINIMITTIIIVIIVILLSLIAVGLLLYCKARSTPVTLSKDQLSGINNIAFSN

SEQ ID NO: 205 - protein, 574 aa, Human respiratory syncytial virus
  F protein of human RSV subtype A/CAA26143
MELLILKANAITTILTAVTFCFASGQNITEEFYQSTCSAVSKGYLSALRTGWYTSVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWFCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 206 - protein, 574 aa, Human respiratory syncytial virus
  F protein of human RSV subtype A/ACO83301
MELLILKANAITTILTAVTFCFASGQNITEEFYQSTCSAVSKGYLSALRTGWYTSVITIELSNIKKNKCNGTDAKIKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAVKSTTNIMITTIIIVIIVILLSLIAVGLLLYCKARSTPVTLSKDQLSGINNIAFSN

SEQ ID NO: 207 - protein, 574 aa, Human respiratory syncytial virus
  F protein of human RSV subtype A/AEQ63564
MELLILKANAITTILTAVTFCFASGQNITEEFYQSTCSAVSKGYLSALRTGWYTSVITIELSNIKKNKCNGTDAKVKLIKQELDKYKNAVTELQLLMQSTQATNNRARRELPRFMNYTLNNAKKTNVTLSKKRKRRFLGFLLGVGSAIASGVAVSKVLHLEGEVNKIKSALLSTNKAVVSLSNGVSVLTSKVLDLKNYIDKQVLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 208 - protein, 574 aa, Human respiratory syncytial virus
  F protein of human RSV subtype A/AGG39418
MELPILKTNAITTILAAVTLCFASSQNITEEFYQSTCSAVSKGYLSALRTGWYTSVITIELSNIKENKCNGTDAKVKLIKQELDKYKNAVTELQLLMQSTPAANNRARRELPRFMNYTLNNTKTTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNTDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSS

SEQ ID NO: 209 - protein, 574 aa, Human respiratory syncytial virus
  F protein of human RSV subtype A/AGG39397
MELPIIKANAITTILIAVTFCFASSQNITEEFYQSTCSAVSKGYLSALRTGWYTSVITIELSNIKENKCNGTDAKVKLIKQELDKYKNAVTELQLLMQSTTAANNRARRELPRFMNYTLNNAKKTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQADTCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 210 - protein, 574 aa, Human respiratory syncytial virus
  F protein of human RSV subtype A/AHY21463
MELPILKTNAITTIFAAVTLCFASSQNITEEFYQSTCSAVSKGYLSALRTGWYTSVITVELSNIKENKCNGTDAKVKLIKQELDKYKNAVTELQLLMQSTPAANNRARRELPRFMNYTLNNTKNTNVTLSKKRKRRFLGFLLGVGSAIASGIAVSKVLHLEGEVNKIKSALLSTNKAVVSLSNGVSVLTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 211 - protein, 574 aa, Human respiratory syncytial virus
  F protein of human RSV subtype B/BAE96918
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIMKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 212 - protein, 574 aa, Human respiratory syncytial virus
  F protein of human RSV subtype B/AFD34266
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 213 - protein, 574 aa, Human respiratory syncytial virus
  F protein of human RSV subtype B/AFP99059
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 214 - protein, 574 aa, Human respiratory syncytial virus
  F protein of human RSV subtype B/AFP99064
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGVAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 215 - protein, 574 aa, Human respiratory syncytial virus
  F protein of human RSV subtype B/AFD34259
MELLIYRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGMAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 216 - protein, 574 aa, Human respiratory syncytial virus
  F protein of human RSV subtype B/ADZ95780
  misc_feature (275)..(275): Xaa can be any naturally occurring amino acid
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMXSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVRGEPIINYYDPLVFPSDEFDASISQVNEKINQSLAFIRRSDELLHNVNTGKSTTNIMITVIIIVIIVVLLSLIAIGLLLYCKAKNTPVTLSKDQLSGINNIAFSK

SEQ ID NO: 217 - protein, 574 aa, Human respiratory syncytial virus
  F protein of human RSV subtype B/ADZ95776
  misc_feature (272)..(272): Xaa can be any naturally occurring amino acid
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKXLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 218 - protein, 574 aa, Human respiratory syncytial virus
  F protein of human RSV subtype B/ADZ95779
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMLSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 219 - protein, 574 aa, Human respiratory syncytial virus
  F protein of human RSV subtype B/AFD34262
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTHMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 220 - protein, 573 aa, Human respiratory syncytial virus
  F protein of human RSV subtype B/AAS93660
MELLIHRSSAIFLTLAINALYLTSSQNITEEFYQSTCSVVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFR

SEQ ID NO: 221 - protein, 573 aa, Human respiratory syncytial virus
  F protein of human RSV subtype B/AAS93661
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFR

SEQ ID NO: 222 - protein, 573 aa, Human respiratory syncytial virus
  F protein of human RSV subtype B/AAS93663
MELLIHRSSAIFLTFAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFR

SEQ ID NO: 223 - protein, 573 aa, Human respiratory syncytial virus
  F protein of human RSV subtype B/AAS93664
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPHYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFR

SEQ ID NO: 224 - protein, 564 aa, Human respiratory syncytial virus
  F protein of human RSV subtype B/AEN74946
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNAQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQL

SEQ ID NO: 225 - protein, 574 aa, Human respiratory syncytial virus
  F protein of human RSV subtype B/AFX60215
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNAQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 226 - protein, 574 aa, Human respiratory syncytial virus
  F protein of human RSV subtype B/AFD34260
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDVSSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 227 - protein, 574 aa, Human respiratory syncytial virus
  F protein of human RSV subtype B/AEO23054
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSTSKKRKRRFLGFLLGVGSAIASGIAVSKVLHLEGEVNKIKNALLATNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 228 - protein, 574 aa, Human respiratory syncytial virus
  F protein of human RSV subtype B/AFI25262
MELLIHRSSAIFLTLAINALYLTSSQNITEEFYQSTCSAVSRGYFSALRTGWYTSVITIELSNIKEIKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDSSISQVNEKINQSLAFIRRSDELLHNVNTGKSTTNIMITAIIIVIIVVLLSLIAIGLLLYCKAKNTPVTLSKDQLSGINNIAFSK

SEQ ID NO: 229 - protein, 574 aa, Human respiratory syncytial virus
  F protein of human RSV subtype B/AFD34261
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFGVNAGVTTPLSTYMLTNSELLSLINDMPITNDQKKLMSSNVQIVRQQSYSIMSIIKEEVLAYVVQLPIYGVIDTHCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 230 - protein, 573 aa, Human respiratory syncytial virus
  F protein of human RSV subtype B/AAS93657
MELLIHRSSAILLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTHCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFR

SEQ ID NO: 231 - protein, 573 aa, Human respiratory syncytial virus
  F protein of human RSV subtype B/AAS93659
MELVIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSVIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFR

SEQ ID NO: 232 - protein, 574 aa, Human respiratory syncytial virus
  F protein of human RSV subtype B/AEQ63586
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 233 - protein, 574 aa, Human respiratory syncytial virus
  F protein of human RSV subtype B/AEQ63608
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPTANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 234 - protein, 574 aa, Human respiratory syncytial virus
  F protein of human RSV subtype B/AEQ63641
MELLIHRSSAIFLTLAINAFYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 235 - protein, 573 aa, Human respiratory syncytial virus
  F protein of human RSV subtype B/AAS93666
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFR

SEQ ID NO: 236 - protein, 574 aa, Human respiratory syncytial virus
  F protein of human RSV subtype B/AFX60212
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNPNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 237 - protein, 573 aa, Human respiratory syncytial virus
  F protein of human RSV subtype B/AFX60214
ELLIHRSSAIFLTLAINALYLTSSQNITEEFYQSTCSAVSRGYLSALRTGWYTSVITIELSNIKEIKCNGTDTKVKLIKQELDKYKNAVTELQLLMQNTPAANNRARREAPQYMNYTINTTKNPNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 238 - protein, 574 aa, Human respiratory syncytial virus
  F protein of human RSV subtype B/AFX60219
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNPNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIIITAIIIVIIVVLLSLIAIGLLLYCKAKNTPVTLSKDQLSGINNIAFSK

SEQ ID NO: 239 - protein, 574 aa, Human respiratory syncytial virus
  F protein of human RSV subtype B/AFD34265
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAANNRARREASQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEIAREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 240 - protein, 574 aa, Human respiratory syncytial virus
  F protein of human RSV subtype B/AEQ63597
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKIQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 241 - protein, 574 aa, Human respiratory syncytial virus
  F protein of human RSV subtype B/AFP99060
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 242 - protein, 574 aa, Human respiratory syncytial virus
  F protein of human RSV subtype B/AEQ63630
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNARVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 243 - protein, 574 aa, Human respiratory syncytial virus
  F protein of human RSV subtype B/AFP99061
MELLIHRSSAIFLTLAINALYLTSSQNITEEFYQSTCSAVSRGYLSALRTGWYTSVITIELSNIKEIKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 244 - protein, 574 aa, Human respiratory syncytial virus
  F protein of human RSV subtype B/AFX60213
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 245 - protein, 574 aa, Human respiratory syncytial virus
  F protein of human RSV subtype B/AFX60220
MELLIHRSSAIFLTLAINALYITSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 246 - protein, 574 aa, Human respiratory syncytial virus
  F protein of human RSV subtype B/AFX60222
MELLIHRSSAIFLTLAINALYITSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQICRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 247 - protein, 574 aa, Human respiratory syncytial virus
  F protein of human RSV subtype B/AFX60231
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTRNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 248 - protein, 574 aa, Human respiratory syncytial virus
  F protein of human RSV subtype B/AFX60232
MELLIYRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 249 - protein, 574 aa, Human respiratory syncytial virus
  F protein of human RSV subtype B/AFX60234
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPAVNNRARREAPQYMNYTINTTKNLNVSISKKRKRRFLGFLLGVGSAIASGIAVSKVLHLEGEVNKIKNALQSTNKAVVSLSNGVSVLTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 250 - protein, 573 aa, Human respiratory syncytial virus
  F protein of human RSV subtype B/AAS93662
MELLIHRSSAIFLTLSINALYLTSSQNITEEFYQSTCSAVSRGYFSALRTGWYTSVITIELSNIKETKCNGTDTKVKLIKQELDKYKNAVTELQLLMQNTPATNNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTQCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFR

SEQ ID NO: 251 - protein, 574 aa, Human respiratory syncytial virus
  F protein of human RSV subtype B/AAB82446
MELLIHRLSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIGTVIEFQQKNSRLLEINREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 252 - protein, 574 aa, Human respiratory syncytial virus
  F protein of human RSV subtype B/NP_056863
MELLIHRLSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEINREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 253 - protein, 574 aa, Human respiratory syncytial virus
  F protein of human RSV subtype B/AAR14266
MELLIHRSSAIFLTLAINALYLTSSQNITEEFYQSTCSAVSRGYFSALRTGWYTSVITIELSNIKETKCNGTDTKVKLIKQELDKYKNAVTELQLLTQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKSYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 254 - protein, 574 aa, Human respiratory syncytial virus
  F protein of human RSV subtype B/ADZ95775
MELLIHRSSAIFLTLAINALYLTSSQNITEEFYQSTCSAVSRGYFSALRTGWYTSVITIELSNIQETKCNGTDTKVKLIKQELDKYKNAVTELQLLMQNTPAVNNRARREAPQYMNHTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKELMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 255 - protein, 564 aa, Human respiratory syncytial virus
  F protein of human RSV subtype B/AEN74944
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGMAVSKVLHLEGEVNKIKNALLSTNKAVVSLSNGVSVLTSKVLDLKNYINNQLLPIVNQQSCRISNIETVIEFQQKNSRLLEITRGFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLCYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKTTPVTLSKDQL

SEQ ID NO: 256 - protein, 564 aa, Human respiratory syncytial virus
  F protein of human RSV subtype B/AEN74945
MELLIHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISTIETVIEFQQKNSRLLEINREFSVNAGVTTPLSTYMLTNSELLSLINDMPITNDQKKLMSSNVQIVRQQSYSIMSIIKEEVLAYVVRLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKTTPVTLSKDQL

SEQ ID NO: 257 - protein, 573 aa, Human respiratory syncytial virus
  F protein of human RSV subtype B/AAS93665
MELLIHRSSAVFLTLAINALYLTSSQNITEEFYQSTCSAVSRGYLSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNAGKSTTNIMITAIIIVIIVVLLSLIAIGLLLYCRAKNTPVTLSKDQLSGINNIAFR

SEQ ID NO: 258 - protein, 574 aa, Human respiratory syncytial virus
  F protein of human RSV subtype B/AFD34264
MELLIHRSSAILLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNGELLSLINDMPITNDQKKLMSSNAQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKEQLSGINNIAFSK

SEQ ID NO: 259 - protein, 574 aa, Human respiratory syncytial virus
  F protein of human RSV subtype B/AGG39514
MELLIHRSSAIFLTLAINALYLTSSQNITEEFYQSTCSAVSRGYLSALRTGWYTSVITIELSNIKETKCNGTDTKVKLIKQELDKYKNAVTELQLLMQNTPVANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNTKEGSNICLTRTDRGWYCDNAGSVSFFPQADTCKVQSNRVFCDTMYSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 260 - protein, 574 aa, Human respiratory syncytial virus
  F protein of human RSV subtype B/AGG39487
MELLIHRSSAIFLTLAVNALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTKNLNVSISKKRKRRFLGFLLGVGSAIASGMAVSKVLHLEGEVNKIKNALLSTNKAVVSLSNGISVLTSKVLDLKNYINNRLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITTIIIVIIVVLLSLIAIGLLLYCKAKNTPVTLSKDQLSGINNIAFSK

SEQ ID NO: 261 - protein, 574 aa, Human respiratory syncytial virus; identical to SEQ ID NO: 211
  F protein of human RSV subtype B/AFI25251

SEQ ID NO: 262 - protein, 574 aa, Human respiratory syncytial virus
  F protein of human RSV subtype B/AGG39523
MELLIHRSIAIFLTLAINALYLTSSQNITEEFYQSTCSAVSRGYFSALRTGWYTSVITIELSNITETKCNGTDTKVKLIKQELDKYKNAVTELQLLMQNTPAANNRARREAPQYMNYTINTTKNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNVGKSTTNIMITAIIIVIIVVLLSLIAIGLLLYCKAKNTPVTLSKDQLSGINNIAFSK

SEQ ID NO: 263 - protein, 574 aa, Human respiratory syncytial virus
  F protein of human RSV subtype B/AGG39502
MELLVHRSSAIFLTLAINALYLTSSQNITEEFYQSTCSAVSRGYFSALRTGWYTSVITIELSNIKETKCNGTDTKVKLIKQELDKYKNAVTELQLLMQNTPAANNRARREAPQYMNYTINTTNNLNVSISKKRKRRFLGFLLGVGSAIASGIAVSKVLHLEGEVNKIKNALLSTNKAVVSLSNGVSVLTSKVLDLKNYINNQLLPIVNQQSCRISNIETVIEFQQKNSRLLEIAREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSDEFDASISQVNEKINQSLAFIRRSDELLHNVNTGKSTTNIMITAIIIVIIVVLLSLIAIGLLLYCKAKNTPVTLSKDQLSGINNIAFSK

SEQ ID NO: 264 - protein, 574 aa, Bovine respiratory syncytial virus
  F protein of Bovine RSV/P22167
MAATAMRMIISIIFISTYMTHITLCQNITEEFYQSTCSAVSRGYLSALRTGWYTSVVTIELSKIQKNVCKSTDSKVKLIKQELERYNNAVIELQSLMQNEPASFSRAKRGIPELIHYTRNSTKRFYGLMGKKRKRRFLGFLLGIGSAIASGVAVSKVLHLEGEVNKIKNALLSTNKAVVSLSNGVSVLTSKVLDLKNYIDKELLPKVNNHDCRISNIETVIEFQQKNNRLLEIAREFSVNAGITTPLSTYMLTNSELLSLINDMPITNDQKKLMSSNVQIVRQQSYSIMSVVKEEVIAYVVQLPIYGVIDTPCWKLHTSPLCTTDNKEGSNICLTRTDRGWYCDNAGSVSFFPQAETCKVQSNRVFCDTMNSLTLPTDVNLCNTDIFNTKYDCKIMTSKTDISSSVITSIGAIVSCYGKTKCTASNKNRGIIKTFSNGCDYVSNKGVDTVSVGNTLYYVNKLEGKALYIKGEPIINYYDPLVFPSDEFDASIAQVNAKINQSLAFIRRSDELLHSVDVGKSTTNVVITTIIIVIVVVILMLIAVGLLFYCKTRSTPIMLGKDQLSGINNLSFSK

SEQ ID NO: 265 - protein, 574 aa, Bovine respiratory syncytial virus
  F protein of Bovine RSV/CAA76980
MATTAMTMIISIIFISTYVTHITLCQNITEEFYQSTCSAVSRGYLSALRTGWYTSVVTIELSKIQKNVCKSTDSKVKLIKQELERYNNAVVELQSLMQNEPASFSRAKRSIPELIHYTRNSTKKFYGLMGKKRKRRFLGFLLGIGSAIASGVAVSKVLHLEGEVNKIKNALLSTNKAVVSLSNGVSVLTSKVLDLKNYIDKELLPKVNNHDCRISNIATVIEFQQKNNRLLEIAREFSVNAGITTPLSTYMLTNSELLSLINDMPITNDQKKLMSSNVQIVRQQSYSIMSVVKEEVIAYVVQLPIYGVIDTPCWKLHTSPLCTTDNKEGSNICLTRTDRGWYCDNAGSVSFFPQAETCKVQSNRVFCDTMNSLTLPTDVNLCNTDIFNTKYDCKIMTSKTDISSSVITSIGAIVSCYGKTKCTASNKNRGIIKTFSNGCDYVSNKGVDTVSVGNTLYYVNKLEGKALYIKGEPIINYYDPLVFPSDEFDASIAQVNAKINQSLAFIRRSDELLHSVDVGKSTTNVVITTIIIVIVVVILMLIAVGLLFYCKTRSTPIMLGKDQLSGINNLSFSK

SEQ ID NO: 266 - protein, 574 aa, Bovine respiratory syncytial virus
  F protein of Bovine RSV/AAL49399
MATTAMRMIISIIFISTYVTHITLCQNITEEFYQSTCSAVSRGYLSALRTGWYTSVVTIELSKIQKNVCNSTDSKVKLIKQELERYNNAVVELQSLMQNEPASFSRAKRGIPELIHYTRNSTKKFYGLMGKKRKRRFLGFLLGIGSAIASGVAVSKVLHLEGEVNKIKNALLSTNKAVVSLSNGVSVLTSKVLDLKNYIDKELLPKVNNHDCRISKIETVIEFQQKNNRLLEIAREFSVNAGITTPLSTYMLTNSELLSLINDMPITNDQKKLMSSNVQIVRQQSYSIMSVVKEEVIAYVVQLPIYGVIDTPCWKLHTSPLCTTDNKEGSNICLTRTDRGWYCDNAGSVSFFPQTETCKVQSNRVFCDTMNSLTLPTDVNLCNTDIFNTKYDCKIMTSKTDISSSVITSIGAIVSCYGKTKCTASNKNRGIIKTFSNGCDYVSNKGVDTVSVGNTLYYVNKLEGKALYIKGEPIINYYDPLVFPSDEFDASIAQVNAKINQSLAFIRRSDELLHSVDVGKSTTNVVITTIIIVIVVVILMLIAVGLLFYCKTKSTPIMLGKDQLSGINNLSFSK

SEQ ID NO: 267 - protein, 574 aa, Bovine respiratory syncytial virus
  F protein of Bovine RSV/NP_048055
MATTAMRMIISIIFISTYVTHITLCQNITEEFYQSTCSAVSRGYLSALRTGWYTSVVTIELSKIQKNVCKSTDSKVKLIKQELERYNNAVVELQSLMQNEPASFSRAKRGIPELIHYTRNSTKKFYGLMGKKRKRRFLGFLLGIGSAVASGVAVSKVLHLEGEVNKIKNALLSTNKAVVSLSNGVSVLTSKVLDLKNYIDKELLPQVNNHDCRISNIETVIEFQQKNNRLLEIAREFSVNAGITTPLSTYMLTNSELLSLINDMPITNDQKKLMSSNVQIVRQQSYSIMSVVKEEVIAYVVQLPIYGVIDTPCWKLHTSPLCTTDNKEGSNICLTRTDRGWYCDNAGSVSFFPQTETCKVQSNRVFCDTMNSLTLPTDVNLCNTDIFNTKYDCKIMTSKTDISSSVITSIGAIVSCYGKTKCTASNKNRGIIKTFSNGCDYVSNKGVDTVSVGNTLYYVNKLEGKALYIKGEPIINYYDPLVFPSDEFDASIAQVNAKINQSLAFIRRSDELLHSVDVGKSTTNVVITTIIIVIVVVILMLIAVGLLFYCKTKSTPIMLGKDQLSGINNLSFSK

SEQ ID NO: 268 - protein, 574 aa, Bovine respiratory syncytial virus
  F protein of Bovine RSV/CAI96787
MATTAMRMIISIIFISTYVTHITLCQNITEEFYQSTCSAVSRGYLSALRTGWYTSVVTIELSKIQKNVCKSTDSKVKLIKQELERYNNAVVELQSLMQNEPGSFSRAKRGIPELIHYTRNSTKKFYGHMGKKRKRRFLGFLLGIGSAIASGVAVSKVLHLEGEVNKIKNALLSTNKAVVSLSNGVSVLTSKVLDLKNYIDKELLPKVNNHDCRISNIETVIDFQQKNNRLLEIAREFSVNAGITTPLSTYMLTNSELLSLINDMPITNDQKKLMSSNVQIVRQQSYSIMSVVKEEVMAYVVQLPIYGVIDTPCWKLHTSPLCTTDNKEGSNICLTRTDRGWYCDNAGSVSFFPQAETCKVQSNRVFCDTMNSLTLPTDVNLCNTDIFNAKYDCKIMTSKTDISSSVITSIGAIVSCYGKTKCTASNKNRGIIKTFSNGCDYVSNKGVDTVSVGNTLYYVNKLEGKALYIKGEPIINYYDPLVFPSDEFDASIAQVNAKINQSLAFIRRSDELLHSVDVGKSTTNVVITTIIIVIVVVILMLIAVGLLFYCKTRSTPIMLGKDQLSGINNLSFSK

SEQ ID NO: 269 - protein, 574 aa, Bovine respiratory syncytial virus
  F protein of Bovine RSV/AAB28458
MGTTAMRMVISIIFISTYVTHITLCQNITEEFYQSTCSAVSRGYLSALRTGWYTSVVTIELSKIQKNVCKSTDSKVKLIKQELERYNNAVIELQSLMQNEPASFSRAKRGIPELIHYPRNSTKRFYGLMGKKRKRRFLGFLLGIGSAIASGVAVSKVLHLEGEVNKIKNALLSTNKAVVSLSNGVSVLTSKVLDLKNYIDKELLPKVNNHDCRISNIGTVIEFQQKNNRLLEIAREFSVNAGITTPLSTYMLTNSELLSLINDMPITNDQKKLMSSNVQIVRQQSYSIMSVVKEEVIAYEVQLPIYGVIDTPCWKIHTSPLCTTDNKEGSNICLTRTDRGWYCDNAGSVSFFPQAETCKVQSNRVFCDTMNSLTLPTDVNLCNTDIFNTKYDCKIMTSKTDISSSVITSIGAIVSCYGKTKCTASNKNRGIIKTFPIGCDYVSNKGVDTVSVGNTLYYVNKLEGKALYIKGEPIINYYDPLVFPSDEFDASIAQVNAKINQSLAFIRRSDELLHSVDVGKSTTNVVITTIIIVIVVVILMLIAVGLLFYCKTRSTPIMLGKDQLSGINNLSFSK

SEQ ID NO: 270 - protein, 569 aa, Bovine respiratory syncytial virus
  F protein of Bovine RSV/AAL49410
MRMIISIILISTYVPHITLCQNITEEFYQSTCSAVSRGYLSALRTGWYTSVVTIELSKIQKNVCNGTDSKVKLIKQELERYNNAVVELQSLMQNEPTSSSRAKRGIPESIHYTRNSTKKFYGLMGKKRKRRFLGFLLGIGSAIASGVAVSKVLHLEGEVNKIKNALLSTNKAVVSLSNGVSVLTSKVLDLKNYIDKELLPKVNNHDCRISNIATVIEFQQKNNRLLEIAREFSVNAGITTPLSTYMLTNSELLSIINDMPITNDQKKLMSSNVQIVRQQSYSIMSVVKEEVIAYVVQLPLYGVIDTPCWKLHTSPLCTTDNEEGSNICLTRTDRGWYCDNAGSVSFFPQAETCKVQSNRVFCDTMNSLTLPTDVNLCNTDIFNAKYDCKIMTSKTDISSSVITSIGAIVSCYGKTKCTASNKNRGIIKTFSNGCDYVSNKGVDTVSVGNTLYYVNKLEGKALYIKGEPIINYYNPLVFPSDEFDASIAQVNAKINQSLAFIRRSDELLHSVDVGKSTTNVVITTIIIVIVVVILMLITVGLLFYCKTRSTPIMLGKDQLSSINNLSFSK

SEQ ID NO: 271 - protein, 537 aa, Artificial Sequence
  Synthetic
MELLILKANAITTILTAVTFCFASGQNITEEFYQSTCSAVSKGYLSALRTGWYHCVITIELSNIKENKCNGTDAKVKLIKQELDKYKNAVTELQLLMQSTPATNNRARRELPRFMNYTLNNAKKTNVTLSKKRKRRFLGFLLGVGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELLGGLVPRGSHHHHHHGSWSHPQFEK

SEQ ID NO: 272 - protein, 545 aa, Artificial Sequence
  Synthetic
MELLILKANAITTILTAVTFCFASGQNITEEFYQSTCSAVSKGYLSALRTGWYHCVITIELSNIKENKCNGTDAKVKLIKQELDKYKNAVTELQLLMQSTPATGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRCCDELLHNVNAGKSTTNIMITTLVPRGSGGSAIGGYIPEAPRDGQAYVRKDGEWVLLSTFLGGHHHHHHGSWSHPQFEK

SEQ ID NO: 273 - protein, 545 aa, Artificial Sequence
  Synthetic
MELLILKANAITTILTAVTFCFASGQNITEEFYQSTCSAVSKGYLSALRTGWYHCVITIELSNIKENKCNGTDAKVKLIKQELDKYKNAVTELQLLMQSTPATGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELLHCCNAGKSTTNIMITTLVPRGSGGSAIGGYIPEAPRDGQAYVRKDGEWVLLSTFLGGHHHHHHGSWSHPQFEK

SEQ ID NO: 274 - protein, 545 aa, Artificial Sequence
  Synthetic
MELLILKANAITTILTAVTFCFASGQNITEEFYQSTCSAVSKGYLSALRTGWYHCVITIELSNIKENKCNGTDAKVKLIKQELDKYKNAVTELQLLMQSTPATGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELLHNVNAGKSCCNIMITTLVPRGSGGSAIGGYIPEAPRDGQAYVRKDGEWVLLSTFLGGHHHHHHGSWSHPQFEK

SEQ ID NO: 275 - protein, 545 aa, Artificial Sequence
  Synthetic
MELLILKANAITTILTAVTFCFASGQNITEEFYQSTCSAVSKGYLSALRTGWYHCVITIELSNIKENKCNGTDAKVKLIKQELDKYKNAVTELQLLMQSTPATGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRCCDELLHCCNAGKSTTNIMITTLVPRGSGGSAIGGYIPEAPRDGQAYVRKDGEWVLLSTFLGGHHHHHHGSWSHPQFEK

SEQ ID NO: 276 - protein, 545 aa, Artificial Sequence
  Synthetic
MELLILKANAITTILTAVTFCFASGQNITEEFYQSTCSAVSKGYLSALRTGWYHCVITIELSNIKENKCNGTDAKVKLIKQELDKYKNAVTELQLLMQSTPATGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRCCDELLHNVNAGKSCCNIMITTLVPRGSGGSAIGGYIPEAPRDGQAYVRKDGEWVLLSTFLGGHHHHHHGSWSHPQFEK

SEQ ID NO: 277 - protein, 545 aa, Artificial Sequence
  Synthetic
MELLILKANAITTILTAVTFCFASGQNITEEFYQSTCSAVSKGYLSALRTGWYHCVITIELSNIKENKCNGTDAKVKLIKQELDKYKNAVTELQLLMQSTPATGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELLHCCNAGKSCCNIMITTLVPRGSGGSAIGGYIPEAPRDGQAYVRKDGEWVLLSTFLGGHHHHHHGSWSHPQFEK

SEQ ID NO: 278 - protein, 545 aa, Artificial Sequence
  Synthetic
MELLILKANAITTILTAVTFCFASGQNITEEFYQSTCSAVSKGYLSALRTGWYHCVITIELSNIKENKCNGTDAKVKLIKQELDKYKNAVTELQLLMQSTPATGSAIASGVAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRCCDELLHCCNAGKSCCNIMITTLVPRGSGGSAIGGYIPEAPRDGQAYVRKDGEWVLLSTFLGGHHHHHHGSWSHPQFEK

SEQ ID NO: 279 - protein, 84 aa, Artificial Sequence; identical to SEQ ID NO: 41
  synthetic polypeptide

SEQ ID NO: 280 - protein, 377 aa, Artificial Sequence
  synthetic polypeptide
FLGFLLGVGSACASGIAVSKVLHLEGEVNKIKSALLSTNKAVVSLSNGVSVLTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELL

SEQ ID NO: 281 - protein, 84 aa, Artificial Sequence; identical to SEQ ID NO: 41
  synthetic polypeptide

SEQ ID NO: 282 - protein, 377 aa, Artificial Sequence; identical to SEQ ID NO: 280
  synthetic polypeptide

SEQ ID NO: 283 - protein, 84 aa, Artificial Sequence; identical to SEQ ID NO: 41
  synthetic polypeptide

SEQ ID NO: 284 - protein, 377 aa, Artificial Sequence; identical to SEQ ID NO: 280
  synthetic polypeptide

SEQ ID NO: 285 - protein, 84 aa, Artificial Sequence; identical to SEQ ID NO: 47
  synthetic polypeptide

SEQ ID NO: 286 - protein, 377 aa, Artificial Sequence
  synthetic polypeptide
FLGFLLGVGSACASGIAVSKVLHLEGEVNKIKNALLSTNKAVVSLSNGVSVLTIKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDVSSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 287 - protein, 84 aa, Artificial Sequence; identical to SEQ ID NO: 47
  synthetic polypeptide

SEQ ID NO: 288 - protein, 377 aa, Artificial Sequence
  synthetic polypeptide
FLGFLLGVGSACASGIAVSKVLHLEGEVNKIKNALLSTNKAVVSLSNGVSVLTIKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIMKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 289 - protein, 84 aa, Artificial Sequence
  synthetic polypeptide
QNITEEFYQSTCSAVSRGYLSALRTGWYTSVITIELSNIKETKCNGTDTKVKLIKQELDKYKNAVTELQLLMQNTPACNNRARR

SEQ ID NO: 290 - protein, 377 aa, Artificial Sequence
  synthetic polypeptide
FLGFLLGVGSACASGIAVSKVLHLEGEVNKIKNALLSTNKAVVSLSNGVSVLTIKVLDLKNYINNQLLPIVNQQSCRISNIETVIEFQQKNSRLLEIAREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 291 - protein, 84 aa, Artificial Sequence; identical to SEQ ID NO: 51
  synthetic polypeptide

SEQ ID NO: 292 - protein, 377 aa, Artificial Sequence
  synthetic polypeptide
FLGFLLGVGSACASGIAVSKVLHLEGEVNKIKSALLSTNKAVVSLSNGVSVLTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEILAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELL

SEQ ID NO: 293 - protein, 84 aa, Artificial Sequence; identical to SEQ ID NO: 51
  synthetic polypeptide

SEQ ID NO: 294 - protein, 377 aa, Artificial Sequence; identical to SEQ ID NO: 292
  synthetic polypeptide

SEQ ID NO: 295 - protein, 84 aa, Artificial Sequence; identical to SEQ ID NO: 51
  synthetic polypeptide

SEQ ID NO: 296 - protein, 377 aa, Artificial Sequence; identical to SEQ ID NO: 292
  synthetic polypeptide

SEQ ID NO: 297 - protein, 84 aa, Artificial Sequence; identical to SEQ ID NO: 57
  synthetic polypeptide

SEQ ID NO: 298 - protein, 377 aa, Artificial Sequence
  synthetic polypeptide
FLGFLLGVGSACASGIAVSKVLHLEGEVNKIKNALLSTNKAVVSLSNGVSVLTIKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEILAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDVSSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 299 - protein, 84 aa, Artificial Sequence; identical to SEQ ID NO: 57
  synthetic polypeptide

SEQ ID NO: 300 - protein, 377 aa, Artificial Sequence
  synthetic polypeptide
FLGFLLGVGSACASGIAVSKVLHLEGEVNKIKNALLSTNKAVVSLSNGVSVLTIKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIMKEEILAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 301 - protein, 84 aa, Artificial Sequence
  synthetic polypeptide
QNITEEFYQSTCSAVSRGYLSALRTGWYHSVITIELSNIKETKCNGTDTKVKLIKQELDKYKNAVTELQLLMQNTPACNNRARR

SEQ ID NO: 302 - protein, 377 aa, Artificial Sequence
  synthetic polypeptide
FLGFLLGVGSACASGIAVSKVLHLEGEVNKIKNALLSTNKAVVSLSNGVSVLTIKVLDLKNYINNQLLPIVNQQSCRISNIETVIEFQQKNSRLLEIAREFSVNAGVTTPLSTYMLTNSELLSLINDMPITNDQKKLMSSNVQIVRQQSYSIMSIIKEEILAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 303 - protein, 84 aa, Artificial Sequence
  synthetic polypeptide
QNITEEFYQSTCSAVSKGYLSALRTGWYHCVITIELSNIKENKCNGTDAKVKLIKQELDKYKNAVTELQLLMQSTPAANNRARR

SEQ ID NO: 304 - protein, 377 aa, Artificial Sequence
  synthetic polypeptide
FLGFLLGVGSAIASGIAVSKVLHLEGEVNKIKSALLSTNKAVVSLSNGVSVCTSKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELL

SEQ ID NO: 305 - protein, 84 aa, Artificial Sequence; identical to SEQ ID NO: 303
  synthetic polypeptide

SEQ ID NO: 306 - protein, 377 aa, Artificial Sequence; identical to SEQ ID NO: 304
  synthetic polypeptide

SEQ ID NO: 307 - protein, 84 aa, Artificial Sequence; identical to SEQ ID NO: 303
  synthetic polypeptide

SEQ ID NO: 308 - protein, 377 aa, Artificial Sequence; identical to SEQ ID NO: 304
  synthetic polypeptide

SEQ ID NO: 309 - protein, 84 aa, Artificial Sequence; identical to SEQ ID NO: 67
  synthetic polypeptide

SEQ ID NO: 310 - protein, 377 aa, Artificial Sequence
  synthetic polypeptide
FLGFLLGVGSAIASGIAVSKVLHLEGEVNKIKNALLSTNKAVVSLSNGVSVCTSKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDVSSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 311 - protein, 84 aa, Artificial Sequence; identical to SEQ ID NO: 67
  synthetic polypeptide

SEQ ID NO: 312 - protein, 377 aa, Artificial Sequence
  synthetic polypeptide
FLGFLLGVGSAIASGIAVSKVLHLEGEVNKIKNALLSTNKAVVSLSNGVSVCTSKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIMKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 313 - protein, 84 aa, Artificial Sequence
  synthetic polypeptide
QNITEEFYQSTCSAVSRGYLSALRTGWYHCVITIELSNIKETKCNGTDTKVKLIKQELDKYKNAVTELQLLMQNTPAANNRARR

SEQ ID NO: 314 - protein, 377 aa, Artificial Sequence
  synthetic polypeptide
FLGFLLGVGSAIASGIAVSKVLHLEGEVNKIKNALLSTNKAVVSLSNGVSVCTSKVLDLKNYINNQLLPIVNQQSCRISNIETVIEFQQKNSRLLEIAREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 315 - protein, 84 aa, Artificial Sequence; identical to SEQ ID NO: 303
  synthetic polypeptide

SEQ ID NO: 316 - protein, 377 aa, Artificial Sequence
  synthetic polypeptide
FLGFLLGVGSAIASGIAVSKVLHLEGEVNKIKSALLSTNKAVVSLSNGVSVCTIKVLDLKNYIDKQLLPIVNKQSCSISNIETVIEFQQKNNRLLEITREFSVNAGVTTPVSTYMLTNSELLSLINDMPITNDQKKLMSNNVQIVRQQSYSIMSIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNIDIFNPKYDCKIMTSKTDVSSSVITSLGAIVSCYGKTKCTASNKNRGIIKTFSNGCDYVSNKGVDTVSVGNTLYYVNKQEGKSLYVKGEPIINFYDPLVFPSSEFDASISQVNEKINQSLAFIRKSDELL

SEQ ID NO: 317 - protein, 84 aa, Artificial Sequence; identical to SEQ ID NO: 303
  synthetic polypeptide

SEQ ID NO: 318 - protein, 377 aa, Artificial Sequence; identical to SEQ ID NO: 316
  synthetic polypeptide

SEQ ID NO: 319 - protein, 84 aa, Artificial Sequence; identical to SEQ ID NO: 303
  synthetic polypeptide

SEQ ID NO: 320 - protein, 377 aa, Artificial Sequence; identical to SEQ ID NO: 316
  synthetic polypeptide

SEQ ID NO: 321 - protein, 84 aa, Artificial Sequence; identical to SEQ ID NO: 67
  synthetic polypeptide

SEQ ID NO: 322 - protein, 377 aa, Artificial Sequence
  synthetic polypeptide
FLGFLLGVGSAIASGIAVSKVLHLEGEVNKIKNALLSTNKAVVSLSNGVSVCTIKVLDLKNYINNQLLPIVNKQSCRISNIETVIEFQQKNSRLLEITREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDVSSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 323 - protein, 84 aa, Artificial Sequence; identical to SEQ ID NO: 67
  synthetic polypeptide

SEQ ID NO: 324 - protein, 377 aa, Artificial Sequence
  synthetic polypeptide
FLGFLLGVGSAIASGIAVSKVLHLEGEVNKIKNALLSTNKAVVSLSNGVSVCTIKVLDLKNYINNQLLPIVNQQSCRISNIETVIEFQQKNSRLLEITREFSVNAGVTTPLSTYMLTNSELLSLINDMPITNDQKKLMSSNVQIVRQQSYSIMSIMKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

SEQ ID NO: 325 - protein, 84 aa, Artificial Sequence; identical to SEQ ID NO: 313
  synthetic polypeptide

SEQ ID NO: 326 - protein, 377 aa, Artificial Sequence
  synthetic polypeptide
FLGFLLGVGSAIASGIAVSKVLHLEGEVNKIKNALLSTNKAVVSLSNGVSVCTIKVLDLKNYINNQLLPIVNQQSCRISNIETVIEFQQKNSRLLEIAREFSVNAGVTTPLSTYMLTNSELLSLINDMPITNDQKKLMSSNVQIVRQQSYSIMSIIKEEVLAYVVQLPIYGVIDTPCWKLHTSPLCTTNIKEGSNICLTRTDRGWYCDNAGSVSFFPQADTCKVQSNRVFCDTMNSLTLPSEVSLCNTDIFNSKYDCKIMTSKTDISSSVITSLGAIVSCYGKTKCTASNKNRGIIKTFSNGCDYVSNKGVDTVSVGNTLYYVNKLEGKNLYVKGEPIINYYDPLVFPSSEFDASISQVNEKINQSLAFIRRSDELL

The invention claimed is:

1. A mutant of a wild-type RSV F protein, which mutant comprises a F1 polypeptide and a F2 polypeptide, wherein the mutant comprises at least one introduced amino acid mutation relative to the amino acid sequence of the wild-type RSV F protein, wherein the introduced amino acid mutation is a pair of cysteine mutations selected from the group consisting of: (1) 55C and 188C; (2) 103C and 148C; and (3) 142C and 371C, and wherein amino acid positions are numbered according to SEQ ID NO: 1.

2. The mutant according to claim 1, wherein the mutant further comprises at least one cavity filling mutation, and at least one electrostatic mutation, wherein the cavity filling mutation is selected from the group consisting of:
 (1) substitution of the amino acid at position 62, 155, 190, or 290 with I, Y, L, H, or M;
 (2) substitution of the amino acid at position 54, 58, 189, 219, or 397 with I, Y, L, H, or M;
 (3) substitution of the amino acid at position 151 with A or H;
 (4) substitution of the amino acid at position 147 or 298 with I, L, H, or M; and
 (5) substitution of the amino acid at position 164, 187, 192, 207, 220, 296, 300, or 495 with I, Y, or H,
 and wherein the electrostatic mutation is selected from the group consisting of:
 (1) substitution of the amino acid at position 82, 92, or 487 by D, F, Q, T, S, L, or H;
 (2) substitution of the amino acid at position 315, 394, or 399 by F, M, R, S, L, I, Q, or T;
 (3) substitution of the amino acid at position 392, 486, or 489 by H, S, N, T, or P; and
 (4) substitution of the amino acid at position 106 or 339 by F, Q, N, or W.

3. The mutant according to claim 1, wherein the C-terminus of the F1 polypeptide is linked to a trimerization domain.

4. The mutant according to claim 1, wherein the F2 polypeptide comprises RSV F amino acid positions 26-109 and F1 polypeptide comprises RSV F amino acid positions 137-513.

5. The mutant according to claim 1, wherein the wild-type RSV is subtype A, subtype B, strain A2, strain Ontario, or strain Buenos Aires.

6. The mutant according to claim 2, wherein the pair of cysteine mutations is selected from the group consisting of: (1) 55C and 188C; and (2) 103C and 148C.

7. The mutant according to claim 2, wherein the cavity filling mutation is selected from the group consisting of:
 (1) substitution of the amino acid at position 190 with I, Y, or M;
 (2) substitution of the amino acid at position 54 with I or H; and
 (3) substitution of the amino acid at position 296 with I.

8. The mutant according to claim 2, wherein the electrostatic mutation is selected from the group consisting of:
 (1) substitution of the amino acid at position 487 with D, Q, or H;
 (2) substitution of the amino acid at position 489 with H, S, or N; and
 (3) substitution of the amino acid at position 486 with H, S, or T.

9. The mutant according to claim 2, wherein:
 (i) the pair of cysteine mutations is selected from the group consisting of: (1) 55C and 188C and (2) 103C and 148C;
 (ii) the cavity filling mutation is selected from the group consisting of:
  (1) substitution of the amino acid at positions 190 with I, Y, or M;
  (2) substitution of the amino acid at position 54 with I or H; and
  (3) substitution of the amino acid at position 296 with I; and
 (iii) the electrostatic mutation is selected from the group consisting of:
  (1) substitution of the amino acid at position 487 with D, Q, or H;
  (2) substitution of the amino acid at position 486 with H, S, or T; and
  (3) substitution of the amino acid at position 489 with H, S, or N.

10. The mutant according to claim 9, wherein the mutant comprises a combination of introduced amino acid mutations selected from the group consisting of:
 (1) combination of 103C, 148C, 190I, and 486S;
 (2) combination of 54H, 55C, 188C, and 486S;
 (3) combination of 54H, 103C, 148C, 190I, 296I, and 486S;
 (4) combination of 54H, 55C, 142C, 188C, 296I, and 371C;
 (5) combination of 55C, 188C, and 486S;
 (6) combination of 54H, 55C, 188C, and 190I;
 (7) combination of 55C, 188C, 190I, and 486S; and
 (8) combination of 54H, 55C, 188C, 190I, and 486S.

11. The mutant according to claim 4, wherein the mutant comprises a cysteine (C) at position 103 (103C) and at position 148 (148C), an isoleucine (I) at position 190 (190I), and a serine (S) at position 486 (486S), and wherein the mutant comprises a F1 polypeptide and a F2 polypeptide selected from the group consisting of:
 (1) a F2 polypeptide comprising the amino acid sequence of SEQ ID NO:41 and a F1 polypeptide comprising the amino acid sequence of SEQ ID NO:42;
 (2) a F2 polypeptide comprising an amino acid sequence that is at least 97% identical to the amino acid sequence of SEQ ID NO:41 and a F1 polypeptide comprising an amino acid sequence that is at least 97% identical to the amino acid sequence of SEQ ID NO:42;
(3) a F2 polypeptide comprising the amino acid sequence of SEQ ID NO: 43 and a F1 polypeptide comprising the amino acid sequence of SEQ ID NO:44;
(4) a F2 polypeptide comprising an amino acid sequence that is at least 97% identical to the amino acid sequence of SEQ ID NO:43 and a F1 polypeptide comprising an amino acid sequence that is at least 97% identical to the amino acid sequence of SEQ ID NO:44;
(5) a F2 polypeptide comprising the amino acid sequence of SEQ ID NO: 45 and a F1 polypeptide comprising the amino acid sequence of SEQ ID NO:46;
(6) a F2 polypeptide comprising an amino acid sequence that is at least 97% identical to the amino acid sequence of SEQ ID NO:45 and a F1 polypeptide comprising an amino acid sequence that is at least 97% identical to the amino acid sequence of SEQ ID NO:46;
(7) a F2 polypeptide comprising the amino acid sequence of SEQ ID NO: 47 and a F1 polypeptide comprising the amino acid sequence of SEQ ID NO:48;
(8) a F2 polypeptide comprising an amino acid sequence that is at least 97% identical to the amino acid sequence of SEQ ID NO:47 and a F1 polypeptide comprising an amino acid sequence that is at least 97% identical to the amino acid sequence of SEQ ID NO:48;
(9) a F2 polypeptide comprising the amino acid sequence of SEQ ID NO: 49 and a F1 polypeptide comprising the amino acid sequence of SEQ ID NO:50;
(10) a F2 polypeptide comprising an amino acid sequence that is at least 97% identical to the amino acid sequence of SEQ ID NO:49 and a F1 polypeptide comprising an amino acid sequence that is at least 97% identical to the amino acid sequence of SEQ ID NO:50;
(11) a F2 polypeptide comprising the amino acid sequence of SEQ ID NO:279 and a F1 polypeptide comprising the amino acid sequence of SEQ ID NO:280;
(12) a F2 polypeptide comprising an amino acid sequence that is at least 97% identical to the amino acid sequence of SEQ ID NO:279 and a F1 polypeptide comprising an amino acid sequence that is at least 97% identical to the amino acid sequence of SEQ ID NO:280;
(13) a F2 polypeptide comprising the amino acid sequence of SEQ ID NO:281 and a F1 polypeptide comprising the amino acid sequence of SEQ ID NO:282;
(14) a F2 polypeptide comprising an amino acid sequence that is at least 97% identical to the amino acid sequence of SEQ ID NO:281 and a F1 polypeptide comprising an amino acid sequence that is at least 97% identical to the amino acid sequence of SEQ ID NO:282;
(15) a F2 polypeptide comprising the amino acid sequence of SEQ ID NO:283 and a F1 polypeptide comprising the amino acid sequence of SEQ ID NO:284;
(16) a F2 polypeptide comprising an amino acid sequence that is at least 97% identical to the amino acid sequence of SEQ ID NO:283 and a F1 polypeptide comprising an amino acid sequence that is at least 97% identical to the amino acid sequence of SEQ ID NO:284;
(17) a F2 polypeptide comprising the amino acid sequence of SEQ ID NO:285 and a F1 polypeptide comprising the amino acid sequence of SEQ ID NO:286;
(18) a F2 polypeptide comprising an amino acid sequence that is at least 97% identical to the amino acid sequence of SEQ ID NO:285 and a F1 polypeptide comprising an amino acid sequence that is at least 97% identical to the amino acid sequence of SEQ ID NO:286;
(19) a F2 polypeptide comprising the amino acid sequence of SEQ ID NO:287 and a F1 polypeptide comprising the amino acid sequence of SEQ ID NO:288;
(20) a F2 polypeptide comprising an amino acid sequence that is at least 97% identical to the amino acid sequence of SEQ ID NO:287 and a F1 polypeptide comprising an amino acid sequence that is at least 97% identical to the amino acid sequence of SEQ ID NO:288;
(21) a F2 polypeptide comprising the amino acid sequence of SEQ ID NO:289 and a F1 polypeptide comprising the amino acid sequence of SEQ ID NO:290; and
(22) a F2 polypeptide comprising an amino acid sequence that is at least 97% identical to the amino acid sequence of SEQ ID NO:289 and a F1 polypeptide comprising an amino acid sequence that is at least 97% identical to the amino acid sequence of SEQ ID NO:290.

12. The mutant according to claim 4, wherein the mutant comprises a histidine (H) at position 54, a cysteine (C) at positions 103 and 148, a isoleucine (I) at positions 190, and 296, and a serine (S) at position 486, and wherein the mutant comprises a F1 polypeptide and a F2 polypeptide selected from the group consisting of:

(1) F2 polypeptide comprising the amino acid sequence of SEQ ID NO: 51 and a F1 polypeptide comprising the amino acid sequence of SEQ ID NO:52;

(2) a F2 polypeptide comprising an amino acid sequence that is at least 97% identical to the amino acid sequence of SEQ ID NO:51 and a F1 polypeptide comprising an amino acid sequence that is at least 97% identical to the amino acid sequence of SEQ ID NO:52;

(3) a F2 polypeptide comprising the amino acid sequence of SEQ ID NO:53 and a F1 polypeptide comprising the amino acid sequence of SEQ ID NO:54;

(4) a F2 polypeptide comprising an amino acid sequence that is at least 97% identical to the amino acid sequence of SEQ ID NO:53 and a F1 polypeptide comprising an amino acid sequence that is at least 97% identical to the amino acid sequence of SEQ ID NO:54;

(5) a F2 polypeptide comprising the amino acid sequence of SEQ ID NO:55 and a F1 polypeptide comprising the amino acid sequence of SEQ ID NO:56;

(6) a F2 polypeptide comprising an amino acid sequence that is at least 97% identical to the amino acid sequence of SEQ ID NO:55 and a F1 polypeptide comprising an amino acid sequence that is at least 97% identical to the amino acid sequence of SEQ ID NO:56;

(7) a F2 polypeptide comprising the amino acid sequence of SEQ ID NO:57 and a F1 polypeptide comprising the amino acid sequence of SEQ ID NO:58;

(8) a F2 polypeptide comprising an amino acid sequence that is at least 97% identical to the amino acid sequence of SEQ ID NO:57 and a F1 polypeptide comprising an amino acid sequence that is at least 97% identical to the amino acid sequence of SEQ ID NO:58;

(9) a F2 polypeptide comprising the amino acid sequence of SEQ ID NO:59 and a F1 polypeptide comprising the amino acid sequence of SEQ ID NO:60;

(10) a F2 polypeptide comprising an amino acid sequence that is at least 97% identical to the amino acid sequence of SEQ ID NO:59 and a F1 polypeptide comprising an amino acid sequence that is at least 97% identical to the amino acid sequence of SEQ ID NO:60;

(11) a F2 polypeptide comprising the amino acid sequence of SEQ ID NO:291 and a F1 polypeptide comprising the amino acid sequence of SEQ ID NO:292;
(12) a F2 polypeptide comprising an amino acid sequence that is at least 97% identical to the amino acid sequence of SEQ ID NO:291 and a F1 polypeptide comprising an amino acid sequence that is at least 97% identical to the amino acid sequence of SEQ ID NO:292;
(13) a F2 polypeptide comprising the amino acid sequence of SEQ ID NO:293 and a F1 polypeptide comprising the amino acid sequence of SEQ ID NO:294;
(14) a F2 polypeptide comprising an amino acid sequence that is at least 97% identical to the amino acid sequence of SEQ ID NO:293 and a F1 polypeptide comprising an amino acid sequence that is at least 97% identical to the amino acid sequence of SEQ ID NO:294;
(15) a F2 polypeptide comprising the amino acid sequence of SEQ ID NO:295 and a F1 polypeptide comprising the amino acid sequence of SEQ ID NO:296;
(16) a F2 polypeptide comprising an amino acid sequence that is at least 97% identical to the amino acid sequence of SEQ ID NO:295 and a F1 polypeptide comprising an amino acid sequence that is at least 97% identical to the amino acid sequence of SEQ ID NO:296;
(17) a F2 polypeptide comprising the amino acid sequence of SEQ ID NO:297 and a F1 polypeptide comprising the amino acid sequence of SEQ ID NO:298;
(18) a F2 polypeptide comprising an amino acid sequence that is at least 97% identical to the amino acid sequence of SEQ ID NO:297 and a F1 polypeptide comprising an amino acid sequence that is at least 97% identical to the amino acid sequence of SEQ ID NO:298;
(19) a F2 polypeptide comprising the amino acid sequence of SEQ ID NO:299 and a F1 polypeptide comprising the amino acid sequence of SEQ ID NO:300;
(20) a F2 polypeptide comprising an amino acid sequence that is at least 97% identical to the amino acid sequence of SEQ ID NO:299 and a F1 polypeptide comprising an amino acid sequence that is at least 97% identical to the amino acid sequence of SEQ ID NO:300;
(21) a F2 polypeptide comprising the amino acid sequence of SEQ ID NO:301 and a F1 polypeptide comprising the amino acid sequence of SEQ ID NO:302; and
(22) a F2 polypeptide comprising an amino acid sequence that is at least 97% identical to the amino acid sequence of SEQ ID NO:301 and a F1 polypeptide comprising an amino acid sequence that is at least 97% identical to the amino acid sequence of SEQ ID NO:302.

13. The mutant according to claim 4, wherein the mutant comprises a histidine (H) at position 54, a cysteine (C) at positions 55 and 188, and a serine (S) at position 486, and wherein the mutant comprises a F1 polypeptide and a F2 polypeptide selected from the group consisting of:

(1) a F2 polypeptide comprising the amino acid sequence of SEQ ID NO:61 and a F1 polypeptide comprising the amino acid sequence of SEQ ID NO:62;

(2) a F2 polypeptide comprising an amino acid sequence that is at least 97% identical to the amino acid sequence of SEQ ID NO:61 and a F1 polypeptide comprising an amino acid sequence that is at least 97% identical to the amino acid sequence of SEQ ID NO:62;

(3) a F2 polypeptide comprising the amino acid sequence of SEQ ID NO:63 and a F1 polypeptide comprising the amino acid sequence of SEQ ID NO:64;

(4) a F2 polypeptide comprising an amino acid sequence that is at least 97% identical to the amino acid sequence of SEQ ID NO:63 and a F1 polypeptide comprising an amino acid sequence that is at least 97% identical to the amino acid sequence of SEQ ID NO:64;

(5) a F2 polypeptide comprising the amino acid sequence of SEQ ID NO:65 and a F1 polypeptide comprising the amino acid sequence of SEQ ID NO:66;

(6) a F2 polypeptide comprising an amino acid sequence that is at least 97% identical to the amino acid sequence of SEQ ID NO:65 and a F1 polypeptide comprising an amino acid sequence that is at least 97% identical to the amino acid sequence of SEQ ID NO:66;

(7) a F2 polypeptide comprising the amino acid sequence of SEQ ID NO:67 and a F1 polypeptide comprising the amino acid sequence of SEQ ID NO:68;

(8) a F2 polypeptide comprising an amino acid sequence that is at least 97% identical to the amino acid sequence of SEQ ID NO:67 and a F1 polypeptide comprising an amino acid sequence that is at least 97% identical to the amino acid sequence of SEQ ID NO:68;

(9) a F2 polypeptide comprising the amino acid sequence of SEQ ID NO:69 and a F1 polypeptide comprising the amino acid sequence of SEQ ID NO:70;

(10) a F2 polypeptide comprising an amino acid sequence that is at least 97% identical to the amino acid sequence of SEQ ID NO:69 and a F1 polypeptide comprising an amino acid sequence that is at least 97% identical to the amino acid sequence of SEQ ID NO:70;

(11) a F2 polypeptide comprising the amino acid sequence of SEQ ID NO:303 and a F1 polypeptide comprising the amino acid sequence of SEQ ID NO:304;

(12) a F2 polypeptide comprising an amino acid sequence that is at least 97% identical to the amino acid sequence of SEQ ID NO:303 and a F1 polypeptide comprising an amino acid sequence that is at least 97% identical to the amino acid sequence of SEQ ID NO:304;

(13) a F2 polypeptide comprising the amino acid sequence of SEQ ID NO:305 and a F1 polypeptide comprising the amino acid sequence of SEQ ID NO:306;

(14) a F2 polypeptide comprising an amino acid sequence that is at least 97% identical to the amino acid sequence of SEQ ID NO:305 and a F1 polypeptide comprising an amino acid sequence that is at least 97% identical to the amino acid sequence of SEQ ID NO:306;

(15) a F2 polypeptide comprising the amino acid sequence of SEQ ID NO:307 and a F1 polypeptide comprising the amino acid sequence of SEQ ID NO:308;

(16) a F2 polypeptide comprising an amino acid sequence that is at least 97% identical to the amino acid sequence of SEQ ID NO:307 and a F1 polypeptide comprising an amino acid sequence that is at least 97% identical to the amino acid sequence of SEQ ID NO:308;

(17) a F2 polypeptide comprising the amino acid sequence of SEQ ID NO:309 and a F1 polypeptide comprising the amino acid sequence of SEQ ID NO:310;

(18) a F2 polypeptide comprising an amino acid sequence that is at least 97% identical to the amino acid sequence of SEQ ID NO:309 and a F1 polypeptide comprising an amino acid sequence that is at least 97% identical to the amino acid sequence of SEQ ID NO:310;

(19) a F2 polypeptide comprising the amino acid sequence of SEQ ID NO:311 and a F1 polypeptide comprising the amino acid sequence of SEQ ID NO:312;

(20) a F2 polypeptide comprising an amino acid sequence that is at least 97% identical to the amino acid sequence of SEQ ID NO:311 and a F1 polypeptide comprising an amino acid sequence that is at least 97% identical to the amino acid sequence of SEQ ID NO:312;

(21) a F2 polypeptide comprising the amino acid sequence of SEQ ID NO:313 and a F1 polypeptide comprising the amino acid sequence of SEQ ID NO:314; and

(22) a F2 polypeptide comprising an amino acid sequence that is at least 97% identical to the amino acid sequence of SEQ ID NO:313 and a F1 polypeptide comprising an amino acid sequence that is at least 97% identical to the amino acid sequence of SEQ ID NO:314.

14. The mutant according to claim 4, wherein the mutant comprises a histidine (H) at position 54, a cysteine (C) at positions 55 and 188, an isoleucine (I) at position 190 (190I), and a serine (S) at position 486, and wherein the mutant comprises a F1 polypeptide and a F2 polypeptide selected from the group consisting of:

(1) a F2 polypeptide comprising the amino acid sequence of SEQ ID NO:71 and a F1 polypeptide comprising the amino acid sequence of SEQ ID NO:72;

(2) a F2 polypeptide comprising an amino acid sequence that is at least 97% identical to the amino acid sequence of SEQ ID NO:71 and a F1 polypeptide comprising an amino acid sequence that is at least 97% identical to the amino acid sequence of SEQ ID NO:72;

(3) a F2 polypeptide comprising the amino acid sequence of SEQ ID NO:73 and a F1 polypeptide comprising the amino acid sequence of SEQ ID NO:74;

(4) a F2 polypeptide comprising an amino acid sequence that is at least 97% identical to the amino acid sequence of SEQ ID NO:73 and a F1 polypeptide comprising an amino acid sequence that is at least 97% identical to the amino acid sequence of SEQ ID NO:74;

(5) a F2 polypeptide comprising the amino acid sequence of SEQ ID NO:75 and a F1 polypeptide comprising the amino acid sequence of SEQ ID NO:76;

(6) a F2 polypeptide comprising an amino acid sequence that is at least 97% identical to the amino acid sequence of SEQ ID NO:75 and a F1 polypeptide comprising an amino acid sequence that is at least 97% identical to the amino acid sequence of SEQ ID NO:76;

(7) a F2 polypeptide comprising the amino acid sequence of SEQ ID NO:77 and a F1 polypeptide comprising the amino acid sequence of SEQ ID NO:78;

(8) a F2 polypeptide comprising an amino acid sequence that is at least 97% identical to the amino acid sequence of SEQ ID NO:77 and a F1 polypeptide comprising an amino acid sequence that is at least 97% identical to the amino acid sequence of SEQ ID NO:78;

(9) a F2 polypeptide comprising the amino acid sequence of SEQ ID NO:79 and a F1 polypeptide comprising the amino acid sequence of SEQ ID NO:80;

(10) a F2 polypeptide comprising an amino acid sequence that is at least 97% identical to the amino acid sequence of SEQ ID NO:79 and a F1 polypeptide comprising an amino acid sequence that is at least 97% identical to the amino acid sequence of SEQ ID NO:80;

(11) a F2 polypeptide comprising the amino acid sequence of SEQ ID NO:315 and a F1 polypeptide comprising the amino acid sequence of SEQ ID NO:316;

(12) a F2 polypeptide comprising an amino acid sequence that is at least 97% identical to the amino acid sequence of SEQ ID NO:315 and a F1 polypeptide comprising an amino acid sequence that is at least 97% identical to the amino acid sequence of SEQ ID NO:316;

(13) a F2 polypeptide comprising the amino acid sequence of SEQ ID NO:317 and a F1 polypeptide comprising the amino acid sequence of SEQ ID NO:318;

(14) a F2 polypeptide comprising an amino acid sequence that is at least 97% identical to the amino acid sequence of SEQ ID NO:317 and a F1 polypeptide comprising an amino acid sequence that is at least 97% identical to the amino acid sequence of SEQ ID NO:318;

(15) a F2 polypeptide comprising the amino acid sequence of SEQ ID NO:319 and a F1 polypeptide comprising the amino acid sequence of SEQ ID NO:320;

(16) a F2 polypeptide comprising an amino acid sequence that is at least 97% identical to the amino acid sequence of SEQ ID NO:319 and a F1 polypeptide comprising an amino acid sequence that is at least 97% identical to the amino acid sequence of SEQ ID NO:320;

(17) a F2 polypeptide comprising the amino acid sequence of SEQ ID NO:321 and a F1 polypeptide comprising the amino acid sequence of SEQ ID NO:322;

(18) a F2 polypeptide comprising an amino acid sequence that is at least 97% identical to the amino acid sequence of SEQ ID NO:321 and a F1 polypeptide comprising an amino acid sequence that is at least 97% identical to the amino acid sequence of SEQ ID NO:322;

(19) a F2 polypeptide comprising the amino acid sequence of SEQ ID NO:323 and a F1 polypeptide comprising the amino acid sequence of SEQ ID NO:324;

(20) a F2 polypeptide comprising an amino acid sequence that is at least 97% identical to the amino acid sequence of SEQ ID NO:323 and a F1 polypeptide comprising an amino acid sequence that is at least 97% identical to the amino acid sequence of SEQ ID NO:324;

(21) a F2 polypeptide comprising the amino acid sequence of SEQ ID NO:325 and a F1 polypeptide comprising the amino acid sequence of SEQ ID NO:326; and

(22) a F2 polypeptide comprising an amino acid sequence that is at least 97% identical to the amino acid sequence of SEQ ID NO:325 and a F1 polypeptide comprising an amino acid sequence that is at least 97% identical to the amino acid sequence of SEQ ID NO:326.

15. The mutant according to claim 1, which comprises amino acids 26-109 and 137-513 of any one of the amino acid sequences of SEQ ID NOs:19-21 and 32-39.

16. The mutant according to claim 1, further comprising at least one pair of introduced cysteine mutations in the HRB region.

17. The mutant according to claim 16, wherein the at least one pair of cysteine mutations in the HRB region is selected from the group consisting of:
(1) 508C and 509C;
(2) 515C and 516C; and
(3) 522C and 523C.

18. A pharmaceutical composition comprising (i) a RSV F protein mutant according to claim 2 and (ii) a pharmaceutically acceptable carrier.

19. The pharmaceutical composition according to claim 18, wherein the F1 polypeptide and F2 polypeptide are from the F protein of RSV subtype B.

20. The pharmaceutical composition according to claim 18, wherein the F1 polypeptide and F2 polypeptide are from the F protein of RSV subtype A.

21. The pharmaceutical composition according to claim 20, further comprising a second mutant according to claim 2, wherein the F1 polypeptide and F2 polypeptide of the second mutant are from the F protein of RSV subtype B.

22. The pharmaceutical composition according to claim 18, which is a vaccine.

23. A nucleic acid molecule comprising a nucleotide sequence that encodes an amino acid sequence of a RSV F protein mutant according to claim 1.

24. The nucleic acid molecule according to claim 23, wherein the mutant comprises amino acids 26-513 of any of the amino acid sequences of SEQ ID NOs:19-21 and 32-39.

25. The nucleic acid molecule according to claim 23, which comprises a nucleotide sequence, or a degenerate variant thereof, selected from the group consisting of:
 (1) a nucleotide sequence comprising nucleotides 76-1539 of SEQ ID NO:8;
 (2) a nucleotide sequence comprising nucleotides 76-1539 of SEQ ID NO:9;
 (3) a nucleotide sequence comprising nucleotides 76-1539 of SEQ ID NO:10;
 (4) a nucleotide sequence comprising nucleotides 76-1539 of SEQ ID NO:11;
 (5) a nucleotide sequence comprising nucleotides 76-1539 of SEQ ID NO:12;
 (6) a nucleotide sequence comprising nucleotides 76-1539 of SEQ ID NO:13;
 (7) a nucleotide sequence comprising nucleotides 76-1539 of SEQ ID NO:14;
 (8) a nucleotide sequence comprising nucleotides 76-1539 of SEQ ID NO:15;
 (9) a nucleotide sequence comprising nucleotides 76-1539 of SEQ ID NO:16;
 (10) a nucleotide sequence comprising nucleotides 76-1539 of SEQ ID NO:17; and
 (11) a nucleotide sequence comprising nucleotides 76-1539 of SEQ ID NO:18.

26. The pharmaceutical composition according to claim 18, further comprising an adjuvant.

27. The pharmaceutical composition according to claim 26, wherein the adjuvant is an aluminum salt.

28. The pharmaceutical composition according to claim 18, wherein the C-terminus of the F1 polypeptide of the mutant is linked to a trimerization domain.

29. The pharmaceutical composition according to claim 28, wherein the trimerization domain is a phage T4 foldon domain.

30. The pharmaceutical composition according to claim 21, wherein the F2 polypeptide and F1 polypeptide of the mutant from the F protein of RSV subtype A comprise the amino acid sequence of SEQ ID NO:45 and the amino acid sequence of SEQ ID NO:46, respectively, and wherein the F2 polypeptide and F1 polypeptide of the second mutant from the F protein of RSV subtype B comprise the amino acid sequence of SEQ ID NO:49 and the amino acid sequence of SEQ ID NO:50, respectively.

31. The pharmaceutical composition according to claim 30, further comprising an adjuvant.

32. The pharmaceutical composition according to claim 31, wherein the adjuvant is an aluminum salt.

33. The pharmaceutical composition according to claim 30, wherein the C-terminus of the F1 polypeptide of the mutant from the F protein of RSV subtype A and the C-terminus of the F1 polypeptide of the second mutant from the F protein of RSV subtype B is each linked to a trimerization domain.

34. The pharmaceutical composition according to claim 33, wherein the trimerization domain is a phage T4 fibritin foldon domain.

35. The pharmaceutical composition according to claim 34, further comprising an adjuvant.

36. The pharmaceutical composition according to claim 35, wherein the adjuvant is an aluminum salt.

37. The mutant according to claim 1, further comprising a cavity filling mutation, or an electrostatic mutation, wherein cavity filling mutation is selected from the group consisting of:
 (1) substitution of the amino acid at position 62, 155, 190, or 290 with I, Y, L, H, or M;
 (2) substitution of the amino acid at position 54, 58, 189, 219, or 397 with I, Y, L, H, or M;
 (3) substitution of the amino acid at position 151 with A or H;
 (4) substitution of the amino acid at position 147 or 298 with I, L, H, or M; and
 (5) substitution of the amino acid at position 164, 187, 192, 207, 220, 296, 300, or 495 with I, Y, H;
and wherein the introduced electrostatic mutation is selected from the group consisting of:
 (1) substitution of the amino acid at position 82, 92, or 487 by D, F, Q, T, S, L, or H;
 (2) substitution of the amino acid at position 315, 394, or 399 by F, M, R, S, L, I, Q, or T;
 (3) substitution of the amino acid at position 392, 486, or 489 by H, S, N, T, or P; and
 (4) substitution of the amino acid at position 106 or 339 by F, Q, N, or W.

38. The mutant according to claim 37, wherein the cavity filling mutation is selected from the group consisting of:
 (1) substitution of the amino acid at position 190 with I, Y, or M;
 (2) substitution of the amino acid at position 54 with I or H; and
 (3) substitution of the amino acid at position 296 with I.

39. The mutant according to claim 37, wherein the electrostatic mutation is selected from the group consisting of:
 (1) substitution of the amino acid at position 487 with D, Q, or H;
 (2) substitution of the amino acid at position 489 with H, S, or N; and
 (3) substitution of the amino acid at position 486 with H, S, or T.

40. The mutant according to claim 38, wherein the electrostatic mutation is selected from the group consisting of:
 (1) substitution of the amino acid at position 487 with D, Q, or H;
 (2) substitution of the amino acid at position 489 with H, S, or N; and
 (3) substitution of the amino acid at position 486 with H, S, or T.

41. The mutant according to claim 40, wherein the pair of cysteine mutations is selected from the group consisting of: (1) 55C and 188C; and (2) 103C and 148C.

42. A pharmaceutical composition, comprising a mutant according to claim 1 and a pharmaceutically acceptable carrier.

43. The pharmaceutical composition according to claim 42, further comprising an adjuvant.

44. The pharmaceutical composition according to claim 42, wherein the C-terminus of the F1 polypeptide of the mutant is linked to a trimerization domain.

* * * * *